United States Patent 12,297,428 (COMPOSITIONS FOR IDENTIFICATION OF MEMBRANE TARGETS FOR ENHANCEMENT OF T CELL ACTIVITY AGAINST CANCER) - sequence listing, part 3

SEQ ID NO: 49410 - DNA, 20 bp, Artificial Sequence
  sgRNA
  Pqlc2_3
ggatcagtgctgctcaacag

SEQ ID NO: 49411 - DNA, 20 bp, Artificial Sequence
  sgRNA
  Pqlc2_4
acagccacatactcacggga

SEQ ID NO: 49412 - DNA, 20 bp, Artificial Sequence
  sgRNA
  Pqlc2_5
acacgctttgaaggatacga

SEQ ID NO: 49413 - DNA, 20 bp, Artificial Sequence
  sgRNA
  Pqlc2_6
cgtgctgctcaagaaccccg

SEQ ID NO: 49414 - DNA, 20 bp, Artificial Sequence
  sgRNA
  Pqlc2_7
cctcactctggcccacctcg

SEQ ID NO: 49415 - DNA, 20 bp, Artificial Sequence
  sgRNA
  Pqlc2_8
tgtcgagcagcagcaccccc

SEQ ID NO: 49416 - DNA, 20 bp, Artificial Sequence
  sgRNA
  Pqlc2_9
ctatcactgtggttcctgct

SEQ ID NO: 49417 - DNA, 20 bp, Artificial Sequence
  sgRNA
  Pqlc2_10
gcaccgttgtgtgggcaaga

SEQ ID NO: 49418 - DNA, 20 bp, Artificial Sequence
  sgRNA
  Pqlc2_11
aggccgtcttgcccacacaa

SEQ ID NO: 49419 - DNA, 20 bp, Artificial Sequence
  sgRNA
  Pqlc2_12
gagtatgtagacagaggggt

SEQ ID NO: 49420 - DNA, 20 bp, Artificial Sequence
  sgRNA
  Pqlc2_13
cagcgtcagcatcatcaggt

SEQ ID NO: 49421 - DNA, 20 bp, Artificial Sequence
  sgRNA
  Pqlc2_14
gttaaaggctggattgtaga

SEQ ID NO: 49422 - DNA, 20 bp, Artificial Sequence
  sgRNA
  Pqlc2_15
gcttgctgtacctgctctcg

SEQ ID NO: 49423 - DNA, 20 bp, Artificial Sequence
  sgRNA
  Pqlc2_16
ggatgtgcacactgaagcag

SEQ ID NO: 49424 - DNA, 20 bp, Artificial Sequence
  sgRNA
  Pqlc2_17
gcaggtagctgccctcactc

SEQ ID NO: 49425 - DNA, 20 bp, Artificial Sequence
  sgRNA
  Pqlc2_18
ggagattcctgcaacctcat

SEQ ID NO: 49426 - DNA, 20 bp, Artificial Sequence
  sgRNA
  Pqlc2_19
caccagtgcgaacagcgagt

SEQ ID NO: 49427 - DNA, 20 bp, Artificial Sequence
  sgRNA
  Pqlc2_20
ggatgagtatgtagacagag

SEQ ID NO: 49428 - DNA, 20 bp, Artificial Sequence
  sgRNA
  Prima1_1
cctgaactaaaccccagagt

SEQ ID NO: 49429 - DNA, 20 bp, Artificial Sequence
  sgRNA
  Prima1_2
ggggcggagagtagtctggg

SEQ ID NO: 49430 - DNA, 20 bp, Artificial Sequence
  sgRNA
  Prima1_3
accttagagcaagacttctg

SEQ ID NO: 49431 - DNA, 20 bp, Artificial Sequence
  sgRNA
  Prima1_4
tctggtgatcattgtcgctg

SEQ ID NO: 49432 - DNA, 20 bp, Artificial Sequence
  sgRNA
  Prima1_5
ctcctcacagagccacaaag

SEQ ID NO: 49433 - DNA, 20 bp, Artificial Sequence
  sgRNA
  Prima1_6
accaccagctgtcctctgca

SEQ ID NO: 49434 - DNA, 20 bp, Artificial Sequence
  sgRNA
  Prima1_7
gctcctcacagagccacaaa

SEQ ID NO: 49435 - DNA, 20 bp, Artificial Sequence
  sgRNA
  Prima1_8
caggacagtcagaaacacca

SEQ ID NO: 49436 - DNA, 20 bp, Artificial Sequence
  sgRNA
  Prima1_9
gacagtcagaaacaccaggg

SEQ ID NO: 49437 - DNA, 20 bp, Artificial Sequence
  sgRNA
  Prima1_10
tgtgcgctgcacccactctg

SEQ ID NO: 49438 - DNA, 20 bp, Artificial Sequence
  sgRNA
  Prima1_11
catggggtactcagcgacac

SEQ ID NO: 49439 - DNA, 20 bp, Artificial Sequence
  sgRNA
  Prima1_12
tttgctacaaagccataaag

SEQ ID NO: 49440 - DNA, 20 bp, Artificial Sequence
  sgRNA
  Prima1_13
ccaggacagtcagaaacacc

SEQ ID NO: 49441 - DNA, 20 bp, Artificial Sequence
  sgRNA
  Prima1_14
gcacagtgcagcagaagtga

SEQ ID NO: 49442 - DNA, 20 bp, Artificial Sequence
  sgRNA
  Prima1_15
ccattctcatcctttctcag

SEQ ID NO: 49443 - DNA, 20 bp, Artificial Sequence
  sgRNA
  Prima1_16
tggctctgtgaggagctcat

SEQ ID NO: 49444 - DNA, 20 bp, Artificial Sequence
  sgRNA
  Prima1_17
gccccagaagtcttgctcta

SEQ ID NO: 49445 - DNA, 20 bp, Artificial Sequence
  sgRNA
  Prima1_18
gctgtcctctgcagggcagg

SEQ ID NO: 49446 - DNA, 20 bp, Artificial Sequence
  sgRNA
  Prima1_19
agtagtctgggaggtggcgg

SEQ ID NO: 49447 - DNA, 20 bp, Artificial Sequence
  sgRNA
  Prima1_20
acctgaactaaaccccagag

SEQ ID NO: 49448 - DNA, 20 bp, Artificial Sequence
  sgRNA
  Prlhr_1
agtgaaatgcgccgacgtag

SEQ ID NO: 49449 - DNA, 20 bp, Artificial Sequence
  sgRNA
  Prlhr_2
acacatgagcacgtcggaca

SEQ ID NO: 49450 - DNA, 20 bp, Artificial Sequence
  sgRNA
  Prlhr_3
ccacgacgtgagcctctgcg

SEQ ID NO: 49451 - DNA, 20 bp, Artificial Sequence
  sgRNA
  Prlhr_4
tgcagacaggttgccctccg

SEQ ID NO: 49452 - DNA, 20 bp, Artificial Sequence
  sgRNA
  Prlhr_5
gctgcacgacagctttcgag

SEQ ID NO: 49453 - DNA, 20 bp, Artificial Sequence
  sgRNA
  Prlhr_6
actgaggctcagcgcctacg

SEQ ID NO: 49454 - DNA, 20 bp, Artificial Sequence
  sgRNA
  Prlhr_7
ggtgcaccagaaccacatag

SEQ ID NO: 49455 - DNA, 20 bp, Artificial Sequence
  sgRNA
  Prlhr_8
ccaacgccagatctacgcct

SEQ ID NO: 49456 - DNA, 20 bp, Artificial Sequence
  sgRNA
  Prlhr_9
gatgctgtacagcatcgtgg

SEQ ID NO: 49457 - DNA, 20 bp, Artificial Sequence
  sgRNA
  Prlhr_10
ccagaacatgactgtcagcg

SEQ ID NO: 49458 - DNA, 20 bp, Artificial Sequence
  sgRNA
  Prlhr_11
agtgaagctgaggaaccgcg

SEQ ID NO: 49459 - DNA, 20 bp, Artificial Sequence
  sgRNA
  Prlhr_12
gagtagctgcaccagcccga

SEQ ID NO: 49460 - DNA, 20 bp, Artificial Sequence
  sgRNA
  Prlhr_13
gcagccatgcatagatgaag

SEQ ID NO: 49461 - DNA, 20 bp, Artificial Sequence
  sgRNA
  Prlhr_14
agccccagaactcctcgcag

SEQ ID NO: 49462 - DNA, 20 bp, Artificial Sequence
  sgRNA
  Prlhr_15
acacccgtacgtaagacagg

SEQ ID NO: 49463 - DNA, 20 bp, Artificial Sequence
  sgRNA
  Prlhr_16
aataggttgaaaatgtgcag

SEQ ID NO: 49464 - DNA, 20 bp, Artificial Sequence
  sgRNA
  Prlhr_17
acagcccagaagacaaatcg

SEQ ID NO: 49465 - DNA, 20 bp, Artificial Sequence
  sgRNA
  Prlhr_18
gcttatgcctttgaacctcg

SEQ ID NO: 49466 - DNA, 20 bp, Artificial Sequence
  sgRNA
  Prlhr_19
ccatgaggcacaatcttgcg

SEQ ID NO: 49467 - DNA, 20 bp, Artificial Sequence
  sgRNA
  Prlhr_20
aacgccagatctacgcctgg

SEQ ID NO: 49468 - DNA, 20 bp, Artificial Sequence
  sgRNA
  Prlr_1
atccacataaagtggatccg

SEQ ID NO: 49469 - DNA, 20 bp, Artificial Sequence
  sgRNA
  Prlr_2
atgtcaatgaataattggtg

SEQ ID NO: 49470 - DNA, 20 bp, Artificial Sequence
  sgRNA
  Prlr_3
atttgatactcatctgctag

SEQ ID NO: 49471 - DNA, 20 bp, Artificial Sequence
  sgRNA
  Prlr_4
tcccattccaaagagtatcc

SEQ ID NO: 49472 - DNA, 20 bp, Artificial Sequence
  sgRNA
  Prlr_5
gattggttctgttcaagcga

SEQ ID NO: 49473 - DNA, 20 bp, Artificial Sequence
  sgRNA
  Prlr_6
gcatctttccaccagttccg

SEQ ID NO: 49474 - DNA, 20 bp, Artificial Sequence
  sgRNA
  Prlr_7
tgaatctccacgtaatctgg

SEQ ID NO: 49475 - DNA, 20 bp, Artificial Sequence
  sgRNA
  Prlr_8
tgctaaacccccagattacg

SEQ ID NO: 49476 - DNA, 20 bp, Artificial Sequence
  sgRNA
  Prlr_9
gcaagcagtacacttccata

SEQ ID NO: 49477 - DNA, 20 bp, Artificial Sequence
  sgRNA
  Prlr_10
actcgctgcaagccagacca

SEQ ID NO: 49478 - DNA, 20 bp, Artificial Sequence
  sgRNA
  Prlr_11
ggtgaatgtttccttgtcag

SEQ ID NO: 49479 - DNA, 20 bp, Artificial Sequence
  sgRNA
  Prlr_12
gtgaatctccacgtaatctg

SEQ ID NO: 49480 - DNA, 20 bp, Artificial Sequence
  sgRNA
  Prlr_13
gggaaagtcttggcacccca

SEQ ID NO: 49481 - DNA, 20 bp, Artificial Sequence
  sgRNA
  Prlr_14
gtgagtctggcactaacacc

SEQ ID NO: 49482 - DNA, 20 bp, Artificial Sequence
  sgRNA
  Prlr_15
gtgggtttaacaccttgacc

SEQ ID NO: 49483 - DNA, 20 bp, Artificial Sequence
  sgRNA
  Prlr_16
gtaaatgccacgaacgaaat

SEQ ID NO: 49484 - DNA, 20 bp, Artificial Sequence
  sgRNA
  Prlr_17
atacaaggtggatccacgcc

SEQ ID NO: 49485 - DNA, 20 bp, Artificial Sequence
  sgRNA
  Prlr_18
tggatgacaatgaggacgag

SEQ ID NO: 49486 - DNA, 20 bp, Artificial Sequence
  sgRNA
  Prlr_19
tttgtagtctggacattcat

SEQ ID NO: 49487 - DNA, 20 bp, Artificial Sequence
  sgRNA
  Prlr_20
agttgttggaatcttcacca

SEQ ID NO: 49488 - DNA, 20 bp, Artificial Sequence
  sgRNA
  Prn_1
agagggcaacaggtactacg

SEQ ID NO: 49489 - DNA, 20 bp, Artificial Sequence
  sgRNA
  Prn_2
ttcaccatgaagaaccggct

SEQ ID NO: 49490 - DNA, 20 bp, Artificial Sequence
  sgRNA
  Prn_3
gcataaagcacaggttcaag

SEQ ID NO: 49491 - DNA, 20 bp, Artificial Sequence
  sgRNA
  Prn_4
cccttgccttgaccgtggag

SEQ ID NO: 49492 - DNA, 20 bp, Artificial Sequence
  sgRNA
  Prn_5
gcaggcagaccatcgccggt

SEQ ID NO: 49493 - DNA, 20 bp, Artificial Sequence
  sgRNA
  Prn_6
ggtactacgcggctaactat

SEQ ID NO: 49494 - DNA, 20 bp, Artificial Sequence
  sgRNA
  Prn_7
gttctcagctacccgagctt

SEQ ID NO: 49495 - DNA, 20 bp, Artificial Sequence
  sgRNA
  Prn_8
attcaccatgaagaaccggc

SEQ ID NO: 49496 - DNA, 20 bp, Artificial Sequence
  sgRNA
  Prn_9
gagccttcatcaagcaaggc

SEQ ID NO: 49497 - DNA, 20 bp, Artificial Sequence
  sgRNA
  Prn_10
gcttgccagccacctctcca

SEQ ID NO: 49498 - DNA, 20 bp, Artificial Sequence
  sgRNA
  Prn_11
gaccatcgccggttggtcca

SEQ ID NO: 49499 - DNA, 20 bp, Artificial Sequence
  sgRNA
  Prn_12
tccaccagcgagtcctgtgg

SEQ ID NO: 49500 - DNA, 20 bp, Artificial Sequence
  sgRNA
  Prn_13
cttgctatcctgcttctccc

SEQ ID NO: 49501 - DNA, 20 bp, Artificial Sequence
  sgRNA
  Prn_14
ccaggagccttcatcaagca

SEQ ID NO: 49502 - DNA, 20 bp, Artificial Sequence
  sgRNA
  Prn_15
ccagaaatcgcagtgcttgg

SEQ ID NO: 49503 - DNA, 20 bp, Artificial Sequence
  sgRNA
  Prn_16
gtggaggtcgcttcgagtgg

SEQ ID NO: 49504 - DNA, 20 bp, Artificial Sequence
  sgRNA
  Prn_17
cctctccacggtcaaggcaa

SEQ ID NO: 49505 - DNA, 20 bp, Artificial Sequence
  sgRNA
  Prn_18
caggttcaagtggaaccgga

SEQ ID NO: 49506 - DNA, 20 bp, Artificial Sequence
  sgRNA
  Prn_19
gccgccacaggactcgctgg

SEQ ID NO: 49507 - DNA, 20 bp, Artificial Sequence
  sgRNA
  Prn_20
gcttgatgaaggctcctggg

SEQ ID NO: 49508 - DNA, 20 bp, Artificial Sequence
  sgRNA
  Prnd_1
gacatcgactttggagcaga

SEQ ID NO: 49509 - DNA, 20 bp, Artificial Sequence
  sgRNA
  Prnd_2
caggttcaagtggaaccgga

SEQ ID NO: 49510 - DNA, 20 bp, Artificial Sequence
  sgRNA
  Prnd_3
actattggcagttccctgat

SEQ ID NO: 49511 - DNA, 20 bp, Artificial Sequence
  sgRNA
  Prnd_4
ccaggagccttcatcaagca

SEQ ID NO: 49512 - DNA, 20 bp, Artificial Sequence
  sgRNA
  Prnd_5
agagggcaacaggtactacg

SEQ ID NO: 49513 - DNA, 20 bp, Artificial Sequence
  sgRNA
  Prnd_6
gcaggcagaccatcgccggt

SEQ ID NO: 49514 - DNA, 20 bp, Artificial Sequence
  sgRNA
  Prnd_7
ggtactacgcggctaactat

SEQ ID NO: 49515 - DNA, 20 bp, Artificial Sequence
  sgRNA
  Prnd_8
gttctcagctacccgagctt

SEQ ID NO: 49516 - DNA, 20 bp, Artificial Sequence
  sgRNA
  Prnd_9
gagccttcatcaagcaaggc

SEQ ID NO: 49517 - DNA, 20 bp, Artificial Sequence
  sgRNA
  Prnd_10
tccaccagcgagtcctgtgg

SEQ ID NO: 49518 - DNA, 20 bp, Artificial Sequence
  sgRNA
  Prnd_11
gcttgccagccacctctcca

SEQ ID NO: 49519 - DNA, 20 bp, Artificial Sequence
  sgRNA
  Prnd_12
cttgctatcctgcttctccc

SEQ ID NO: 49520 - DNA, 20 bp, Artificial Sequence
  sgRNA
  Prnd_13
gaccatcgccggttggtcca

SEQ ID NO: 49521 - DNA, 20 bp, Artificial Sequence
  sgRNA
  Prnd_14
ccagaaatcgcagtgcttgg

SEQ ID NO: 49522 - DNA, 20 bp, Artificial Sequence
  sgRNA
  Prnd_15
cctctccacggtcaaggcaa

SEQ ID NO: 49523 - DNA, 20 bp, Artificial Sequence
  sgRNA
  Prnd_16
gccgccacaggactcgctgg

SEQ ID NO: 49524 - DNA, 20 bp, Artificial Sequence
  sgRNA
  Prnd_17
gcttgatgaaggctcctggg

SEQ ID NO: 49525 - DNA, 20 bp, Artificial Sequence
  sgRNA
  Prnd_18
gcggccagatcaccgaagct

SEQ ID NO: 49526 - DNA, 20 bp, Artificial Sequence
  sgRNA
  Prnd_19
caagcactgcgatttctggc

SEQ ID NO: 49527 - DNA, 20 bp, Artificial Sequence
  sgRNA
  Prnd_20
tatgccccttgccttgaccg

SEQ ID NO: 49528 - DNA, 20 bp, Artificial Sequence
  sgRNA
  Prnp_1
tggccccatccaccgccatg

SEQ ID NO: 49529 - DNA, 20 bp, Artificial Sequence
  sgRNA
  Prnp_2
gtgactatgtggactgatgt

SEQ ID NO: 49530 - DNA, 20 bp, Artificial Sequence
  sgRNA
  Prnp_3
aaaaaccaacctcaagcatg

SEQ ID NO: 49531 - DNA, 20 bp, Artificial Sequence
  sgRNA
  Prnp_4
accctaaccaagtgtactac

SEQ ID NO: 49532 - DNA, 20 bp, Artificial Sequence
  sgRNA
  Prnp_5
tctcccgtcgtaataggcct

SEQ ID NO: 49533 - DNA, 20 bp, Artificial Sequence
  sgRNA
  Prnp_6
tgtccccagccaccaccgtg

SEQ ID NO: 49534 - DNA, 20 bp, Artificial Sequence
  sgRNA
  Prnp_7
gagtcccaggcctattacga

SEQ ID NO: 49535 - DNA, 20 bp, Artificial Sequence
  sgRNA
  Prnp_8
tgaccccaactaccaccatg

SEQ ID NO: 49536 - DNA, 20 bp, Artificial Sequence
  sgRNA
  Prnp_9
tgtgaagatgatggagcgcg

SEQ ID NO: 49537 - DNA, 20 bp, Artificial Sequence
  sgRNA
  Prnp_10
agtacacttggttagggtag

SEQ ID NO: 49538 - DNA, 20 bp, Artificial Sequence
  sgRNA
  Prnp_11
gtgcgtcacccagtaccaga

SEQ ID NO: 49539 - DNA, 20 bp, Artificial Sequence
  sgRNA
  Prnp_12
cggtcaccaccaccaccaag

SEQ ID NO: 49540 - DNA, 20 bp, Artificial Sequence
  sgRNA
  Prnp_13
gcctgtagtacacttggtta

SEQ ID NO: 49541 - DNA, 20 bp, Artificial Sequence
  sgRNA
  Prnp_14
tgtccccagctgcccccatg

SEQ ID NO: 49542 - DNA, 20 bp, Artificial Sequence
  sgRNA
  Prnp_15
ggatcttctcccgtcgtaat

SEQ ID NO: 49543 - DNA, 20 bp, Artificial Sequence
  sgRNA
  Prnp_16
atgtcggcctctgcaaaaag

SEQ ID NO: 49544 - DNA, 20 bp, Artificial Sequence
  sgRNA
  Prnp_17
cagcccctgccacatgcttg

SEQ ID NO: 49545 - DNA, 20 bp, Artificial Sequence
  sgRNA
  Prnp_18
ggctggggacaaccccatgg

SEQ ID NO: 49546 - DNA, 20 bp, Artificial Sequence
  sgRNA
  Prnp_19
gggcttgttccactgattat

SEQ ID NO: 49547 - DNA, 20 bp, Artificial Sequence
  sgRNA
  Prnp_20
ggtgaccgtgtgctgcttga

SEQ ID NO: 49548 - DNA, 20 bp, Artificial Sequence
  sgRNA
  Procr_1
tccaagacaaccatcatgtg

SEQ ID NO: 49549 - DNA, 20 bp, Artificial Sequence
  sgRNA
  Procr_2
tgcgccctttgtaactccga

SEQ ID NO: 49550 - DNA, 20 bp, Artificial Sequence
  sgRNA
  Procr_3
gctggtatatcgcgagcgca

SEQ ID NO: 49551 - DNA, 20 bp, Artificial Sequence
  sgRNA
  Procr_4
gccacatcgaagaagacatg

SEQ ID NO: 49552 - DNA, 20 bp, Artificial Sequence
  sgRNA
  Procr_5
tcttcatgtgcacaagtgga

SEQ ID NO: 49553 - DNA, 20 bp, Artificial Sequence
  sgRNA
  Procr_6
agcagctcaatgcctacaac

SEQ ID NO: 49554 - DNA, 20 bp, Artificial Sequence
  sgRNA
  Procr_7
aaaactcctgacacacacgc

SEQ ID NO: 49555 - DNA, 20 bp, Artificial Sequence
  sgRNA
  Procr_8
gtgaagttggctgctttgga

SEQ ID NO: 49556 - DNA, 20 bp, Artificial Sequence
  sgRNA
  Procr_9
gcttcaccaggctttcgaac

SEQ ID NO: 49557 - DNA, 20 bp, Artificial Sequence
  sgRNA
  Procr_10
gtaggcattgagctgcttca

SEQ ID NO: 49558 - DNA, 20 bp, Artificial Sequence
  sgRNA
  Procr_11
actgggtcagatagatctgc

SEQ ID NO: 49559 - DNA, 20 bp, Artificial Sequence
  sgRNA
  Procr_12
atgggctgtttcataatcgc

SEQ ID NO: 49560 - DNA, 20 bp, Artificial Sequence
  sgRNA
  Procr_13
ataatcgctggtgtggccgt

SEQ ID NO: 49561 - DNA, 20 bp, Artificial Sequence
  sgRNA
  Procr_14
cataatcgctggtgtggccg

SEQ ID NO: 49562 - DNA, 20 bp, Artificial Sequence
  sgRNA
  Procr_15
ggccacatcgaagaagacat

SEQ ID NO: 49563 - DNA, 20 bp, Artificial Sequence
  sgRNA
  Procr_16
aggtcgctcttacacatcac

SEQ ID NO: 49564 - DNA, 20 bp, Artificial Sequence
  sgRNA
  Procr_17
actggtcctgggcatcctga

SEQ ID NO: 49565 - DNA, 20 bp, Artificial Sequence
  sgRNA
  Procr_18
cagctctccggatcctgcca

SEQ ID NO: 49566 - DNA, 20 bp, Artificial Sequence
  sgRNA
  Procr_19
accccatgtcttcttcgatg

SEQ ID NO: 49567 - DNA, 20 bp, Artificial Sequence
  sgRNA
  Procr_20
ctgggagcctgacacccaca

SEQ ID NO: 49568 - DNA, 20 bp, Artificial Sequence
  sgRNA
  Prokr2_1
cgtacagggagaccgtacga

SEQ ID NO: 49569 - DNA, 20 bp, Artificial Sequence
  sgRNA
  Prokr2_2
tcaaagggtggacaatagcg

SEQ ID NO: 49570 - DNA, 20 bp, Artificial Sequence
  sgRNA
  Prokr2_3
cttctgtggtcagatctggt

SEQ ID NO: 49571 - DNA, 20 bp, Artificial Sequence
  sgRNA
  Prokr2_4
cataatagtccatctcaaag

SEQ ID NO: 49572 - DNA, 20 bp, Artificial Sequence
  sgRNA
  Prokr2_5
tctccttcacaactaccgtg

SEQ ID NO: 49573 - DNA, 20 bp, Artificial Sequence
  sgRNA
  Prokr2_6
gcactccacgacgtagaagg

SEQ ID NO: 49574 - DNA, 20 bp, Artificial Sequence
  sgRNA
  Prokr2_7
cctcgacctcaaaaccagcg

SEQ ID NO: 49575 - DNA, 20 bp, Artificial Sequence
  sgRNA
  Prokr2_8
gacttactcccgtagtgaga

SEQ ID NO: 49576 - DNA, 20 bp, Artificial Sequence
  sgRNA
  Prokr2_9
gcagtagcactgtcttgcgg

SEQ ID NO: 49577 - DNA, 20 bp, Artificial Sequence
  sgRNA
  Prokr2_10
ggtgattatgacctccccct

SEQ ID NO: 49578 - DNA, 20 bp, Artificial Sequence
  sgRNA
  Prokr2_11
agtgcgagacttcttcccca

SEQ ID NO: 49579 - DNA, 20 bp, Artificial Sequence
  sgRNA
  Prokr2_12
gatacaatccacctcttcag

SEQ ID NO: 49580 - DNA, 20 bp, Artificial Sequence
  sgRNA
  Prokr2_13
gcggtctgataattcatccg

SEQ ID NO: 49581 - DNA, 20 bp, Artificial Sequence
  sgRNA
  Prokr2_14
tggtgattatgacctccccc

SEQ ID NO: 49582 - DNA, 20 bp, Artificial Sequence
  sgRNA
  Prokr2_15
tggccaggttagcaatgagg

SEQ ID NO: 49583 - DNA, 20 bp, Artificial Sequence
  sgRNA
  Prokr2_16
tgagcagtagcactgtcttg

SEQ ID NO: 49584 - DNA, 20 bp, Artificial Sequence
  sgRNA
  Prokr2_17
agacggagcaaatccgcaag

SEQ ID NO: 49585 - DNA, 20 bp, Artificial Sequence
  sgRNA
  Prokr2_18
cttggaatcgcactgaaaga

SEQ ID NO: 49586 - DNA, 20 bp, Artificial Sequence
  sgRNA
  Prokr2_19
gcttgagttcgtgggtcccg

SEQ ID NO: 49587 - DNA, 20 bp, Artificial Sequence
  sgRNA
  Prokr2_20
ggacttactcccgtagtgag

SEQ ID NO: 49588 - DNA, 20 bp, Artificial Sequence
  sgRNA
  Prom1_1
gagtgaagactcacgccatg

SEQ ID NO: 49589 - DNA, 20 bp, Artificial Sequence
  sgRNA
  Prom1_2
aaggactccgatctcataga

SEQ ID NO: 49590 - DNA, 20 bp, Artificial Sequence
  sgRNA
  Prom1_3
cagcaacagatacttaaacc

SEQ ID NO: 49591 - DNA, 20 bp, Artificial Sequence
  sgRNA
  Prom1_4
caaagccatatataatgcca

SEQ ID NO: 49592 - DNA, 20 bp, Artificial Sequence
  sgRNA
  Prom1_5
aacagcagagtccatcgcgg

SEQ ID NO: 49593 - DNA, 20 bp, Artificial Sequence
  sgRNA
  Prom1_6
cattcggctggaccacgttg

SEQ ID NO: 49594 - DNA, 20 bp, Artificial Sequence
  sgRNA
  Prom1_7
cgttgctgcaacaaatgcgg

SEQ ID NO: 49595 - DNA, 20 bp, Artificial Sequence
  sgRNA
  Prom1_8
attgaactgttggataacac

SEQ ID NO: 49596 - DNA, 20 bp, Artificial Sequence
  sgRNA
  Prom1_9
agaccaggactcggatcaaa

SEQ ID NO: 49597 - DNA, 20 bp, Artificial Sequence
  sgRNA
  Prom1_10
ggtgcacatcttcctcaacg

SEQ ID NO: 49598 - DNA, 20 bp, Artificial Sequence
  sgRNA
  Prom1_11
tcatgagcagacaaatcacc

SEQ ID NO: 49599 - DNA, 20 bp, Artificial Sequence
  sgRNA
  Prom1_12
ccatggccttaatctcttcg

SEQ ID NO: 49600 - DNA, 20 bp, Artificial Sequence
  sgRNA
  Prom1_13
ggataatgaacagcagtccc

SEQ ID NO: 49601 - DNA, 20 bp, Artificial Sequence
  sgRNA
  Prom1_14
catgccaccccaactagaag

SEQ ID NO: 49602 - DNA, 20 bp, Artificial Sequence
  sgRNA
  Prom1_15
gatgacatcctgcaaaccca

SEQ ID NO: 49603 - DNA, 20 bp, Artificial Sequence
  sgRNA
  Prom1_16
ctagagggaagtcattcggc

SEQ ID NO: 49604 - DNA, 20 bp, Artificial Sequence
  sgRNA
  Prom1_17
gctgaaacaggccttcttac

SEQ ID NO: 49605 - DNA, 20 bp, Artificial Sequence
  sgRNA
  Prom1_18
tctggagagcctcgtcaaaa

SEQ ID NO: 49606 - DNA, 20 bp, Artificial Sequence
  sgRNA
  Prom1_19
ttgatagcaatgattacagc

SEQ ID NO: 49607 - DNA, 20 bp, Artificial Sequence
  sgRNA
  Prom1_20
cagaatgtgcaaagtcctcg

SEQ ID NO: 49608 - DNA, 20 bp, Artificial Sequence
  sgRNA
  Prom2_1
cgtgcgacgattcctctccg

SEQ ID NO: 49609 - DNA, 20 bp, Artificial Sequence
  sgRNA
  Prom2_2
aacacacacatagtcagacg

SEQ ID NO: 49610 - DNA, 20 bp, Artificial Sequence
  sgRNA
  Prom2_3
aacaatatgagacatacagg

SEQ ID NO: 49611 - DNA, 20 bp, Artificial Sequence
  sgRNA
  Prom2_4
gccacgaggagaattgcaag

SEQ ID NO: 49612 - DNA, 20 bp, Artificial Sequence
  sgRNA
  Prom2_5
cctcgcccttggtttcagag

SEQ ID NO: 49613 - DNA, 20 bp, Artificial Sequence
  sgRNA
  Prom2_6
ggttaagttgaaccacggag

SEQ ID NO: 49614 - DNA, 20 bp, Artificial Sequence
  sgRNA
  Prom2_7
gatgcaggacatcatccaca

SEQ ID NO: 49615 - DNA, 20 bp, Artificial Sequence
  sgRNA
  Prom2_8
tcgatatgaggcaggctacg

SEQ ID NO: 49616 - DNA, 20 bp, Artificial Sequence
  sgRNA
  Prom2_9
ggttacagatcaccacaagc

SEQ ID NO: 49617 - DNA, 20 bp, Artificial Sequence
  sgRNA
  Prom2_10
gtatacccacaagattcagc

SEQ ID NO: 49618 - DNA, 20 bp, Artificial Sequence
  sgRNA
  Prom2_11
cacggagaggaatcgtcgca

SEQ ID NO: 49619 - DNA, 20 bp, Artificial Sequence
  sgRNA
  Prom2_12
gcacaaggaagcctctgtag

SEQ ID NO: 49620 - DNA, 20 bp, Artificial Sequence
  sgRNA
  Prom2_13
aagctcctgctgaatcttgt

SEQ ID NO: 49621 - DNA, 20 bp, Artificial Sequence
  sgRNA
  Prom2_14
gctcctggttcaagtgcagg

SEQ ID NO: 49622 - DNA, 20 bp, Artificial Sequence
  sgRNA
  Prom2_15
ggtcagccatcatgtcacac

SEQ ID NO: 49623 - DNA, 20 bp, Artificial Sequence
  sgRNA
  Prom2_16
ctgtggatgatgtcctgcat

SEQ ID NO: 49624 - DNA, 20 bp, Artificial Sequence
  sgRNA
  Prom2_17
gatcacatgaccattgtcca

SEQ ID NO: 49625 - DNA, 20 bp, Artificial Sequence
  sgRNA
  Prom2_18
ccaagtacttccgtcccatc

SEQ ID NO: 49626 - DNA, 20 bp, Artificial Sequence
  sgRNA
  Prom2_19
tggagcacctggcattcgct

SEQ ID NO: 49627 - DNA, 20 bp, Artificial Sequence
  sgRNA
  Prom2_20
ctgtggtgaacactgacatg

SEQ ID NO: 49628 - DNA, 20 bp, Artificial Sequence
  sgRNA
  Prph2_1
cagtcgcatcaagagcaacg

SEQ ID NO: 49629 - DNA, 20 bp, Artificial Sequence
  sgRNA
  Prph2_2
gaggacgatgccggccaaca

SEQ ID NO: 49630 - DNA, 20 bp, Artificial Sequence
  sgRNA
  Prph2_3
gtactggatacagggccgcg

SEQ ID NO: 49631 - DNA, 20 bp, Artificial Sequence
  sgRNA
  Prph2_4
tgaagattgaacttcgcaag

SEQ ID NO: 49632 - DNA, 20 bp, Artificial Sequence
  sgRNA
  Prph2_5
gtaccagctcaccaacaact

SEQ ID NO: 49633 - DNA, 20 bp, Artificial Sequence
  sgRNA
  Prph2_6
tggcttacggactcaagaat

SEQ ID NO: 49634 - DNA, 20 bp, Artificial Sequence
  sgRNA
  Prph2_7
attcttgagtccgtaagcca

SEQ ID NO: 49635 - DNA, 20 bp, Artificial Sequence
  sgRNA
  Prph2_8
tgaaagggacgccgtccacc

SEQ ID NO: 49636 - DNA, 20 bp, Artificial Sequence
  sgRNA
  Prph2_9
ggagagtgtgtctaacccgg

SEQ ID NO: 49637 - DNA, 20 bp, Artificial Sequence
  sgRNA
  Prph2_10
cagctatgaccatcagactg

SEQ ID NO: 49638 - DNA, 20 bp, Artificial Sequence
  sgRNA
  Prph2_11
gtaagccagggtgctctcca

SEQ ID NO: 49639 - DNA, 20 bp, Artificial Sequence
  sgRNA
  Prph2_12
actgaatctcgaaccagtcc

SEQ ID NO: 49640 - DNA, 20 bp, Artificial Sequence
  sgRNA
  Prph2_13
gctgggcaagagcaatcagg

SEQ ID NO: 49641 - DNA, 20 bp, Artificial Sequence
  sgRNA
  Prph2_14
gcatcaagagcaacgtggat

SEQ ID NO: 49642 - DNA, 20 bp, Artificial Sequence
  sgRNA
  Prph2_15
agcagcctcatgaattccat

SEQ ID NO: 49643 - DNA, 20 bp, Artificial Sequence
  sgRNA
  Prph2_16
agtacgccaagtggaagccc

SEQ ID NO: 49644 - DNA, 20 bp, Artificial Sequence
  sgRNA
  Prph2_17
cttcagccagggcttccact

SEQ ID NO: 49645 - DNA, 20 bp, Artificial Sequence
  sgRNA
  Prph2_18
gctgtagtaattcagcagag

SEQ ID NO: 49646 - DNA, 20 bp, Artificial Sequence
  sgRNA
  Prph2_19
ctctgctgctttctgttgcg

SEQ ID NO: 49647 - DNA, 20 bp, Artificial Sequence
  sgRNA
  Prph2_20
gcatcgtcctcttcagcttg

SEQ ID NO: 49648 - DNA, 20 bp, Artificial Sequence
  sgRNA
  Prrt3_1
gcagccactagtgctaatcg

SEQ ID NO: 49649 - DNA, 20 bp, Artificial Sequence
  sgRNA
  Prrt3_2
accacgccgagatgtcgagg

SEQ ID NO: 49650 - DNA, 20 bp, Artificial Sequence
  sgRNA
  Prrt3_3
tgtctcgggtaccggagtgt

SEQ ID NO: 49651 - DNA, 20 bp, Artificial Sequence
  sgRNA
  Prrt3_4
tctgatgggcacctaagacc

SEQ ID NO: 49652 - DNA, 20 bp, Artificial Sequence
  sgRNA
  Prrt3_5
gcgggcacatcattgctccg

SEQ ID NO: 49653 - DNA, 20 bp, Artificial Sequence
  sgRNA
  Prrt3_6
gaccacgccgagatgtcgag

SEQ ID NO: 49654 - DNA, 20 bp, Artificial Sequence
  sgRNA
  Prrt3_7
ggactggcatcccagccccg

SEQ ID NO: 49655 - DNA, 20 bp, Artificial Sequence
  sgRNA
  Prrt3_8
agaccacgccgagatgtcga

SEQ ID NO: 49656 - DNA, 20 bp, Artificial Sequence
  sgRNA
  Prrt3_9
gacccaataactgctatgcg

SEQ ID NO: 49657 - DNA, 20 bp, Artificial Sequence
  sgRNA
  Prrt3_10
cgacgtgcgcaagcacacct

SEQ ID NO: 49658 - DNA, 20 bp, Artificial Sequence
  sgRNA
  Prrt3_11
ggggtcggctccattcagcg

SEQ ID NO: 49659 - DNA, 20 bp, Artificial Sequence
  sgRNA
  Prrt3_12
ggatcctgctgggtgagtag

SEQ ID NO: 49660 - DNA, 20 bp, Artificial Sequence
  sgRNA
  Prrt3_13
agatccagctcgctcagcga

SEQ ID NO: 49661 - DNA, 20 bp, Artificial Sequence
  sgRNA
  Prrt3_14
tgaggttctgagttctccag

SEQ ID NO: 49662 - DNA, 20 bp, Artificial Sequence
  sgRNA
  Prrt3_15
agcgatgcagccgaacccca

SEQ ID NO: 49663 - DNA, 20 bp, Artificial Sequence
  sgRNA
  Prrt3_16
gcgcctgctggaattgacct

SEQ ID NO: 49664 - DNA, 20 bp, Artificial Sequence
  sgRNA
  Prrt3_17
gaaactcagcacccgccgaa

SEQ ID NO: 49665 - DNA, 20 bp, Artificial Sequence
  sgRNA
  Prrt3_18
agctggctgagggctccgga

SEQ ID NO: 49666 - DNA, 20 bp, Artificial Sequence
  sgRNA
  Prrt3_19
ggaacttcgctcttccctgt

SEQ ID NO: 49667 - DNA, 20 bp, Artificial Sequence
  sgRNA
  Prrt3_20
cacgtgatggagccgcccgt

SEQ ID NO: 49668 - DNA, 20 bp, Artificial Sequence
  sgRNA
  Prss21_1
agtggttgccccatacacgc

SEQ ID NO: 49669 - DNA, 20 bp, Artificial Sequence
  sgRNA
  Prss21_2
cgccacccactatacgggaa

SEQ ID NO: 49670 - DNA, 20 bp, Artificial Sequence
  sgRNA
  Prss21_3
tgagaaccgaactgactgct

SEQ ID NO: 49671 - DNA, 20 bp, Artificial Sequence
  sgRNA
  Prss21_4
acagtcaacctatttgcagg

SEQ ID NO: 49672 - DNA, 20 bp, Artificial Sequence
  sgRNA
  Prss21_5
gcaaggttgcgccacataag

SEQ ID NO: 49673 - DNA, 20 bp, Artificial Sequence
  sgRNA
  Prss21_6
gatacggtgtggtatcaggt

SEQ ID NO: 49674 - DNA, 20 bp, Artificial Sequence
  sgRNA
  Prss21_7
aaccttgctcaaccgccgct

SEQ ID NO: 49675 - DNA, 20 bp, Artificial Sequence
  sgRNA
  Prss21_8
agtcaaccatgatccgcaat

SEQ ID NO: 49676 - DNA, 20 bp, Artificial Sequence
  sgRNA
  Prss21_9
tcggttctcaaacttgtacg

SEQ ID NO: 49677 - DNA, 20 bp, Artificial Sequence
  sgRNA
  Prss21_10
gggatggtcctgtgaccgca

SEQ ID NO: 49678 - DNA, 20 bp, Artificial Sequence
  sgRNA
  Prss21_11
acatcagtcatcactacaac

SEQ ID NO: 49679 - DNA, 20 bp, Artificial Sequence
  sgRNA
  Prss21_12
gatactgctccgagtacttg

SEQ ID NO: 49680 - DNA, 20 bp, Artificial Sequence
  sgRNA
  Prss21_13
tgtggtcgccccaatcgccc

SEQ ID NO: 49681 - DNA, 20 bp, Artificial Sequence
  sgRNA
  Prss21_14
cctgcgaccaggatacggtg

SEQ ID NO: 49682 - DNA, 20 bp, Artificial Sequence
  sgRNA
  Prss21_15
gggcagctgtaagcacccag

SEQ ID NO: 49683 - DNA, 20 bp, Artificial Sequence
  sgRNA
  Prss21_16
ttgagaaccgaactgactgc

SEQ ID NO: 49684 - DNA, 20 bp, Artificial Sequence
  sgRNA
  Prss21_17
gtatcctggtcgcaggccaa

SEQ ID NO: 49685 - DNA, 20 bp, Artificial Sequence
  sgRNA
  Prss21_18
gggctggatgaagttattgt

SEQ ID NO: 49686 - DNA, 20 bp, Artificial Sequence
  sgRNA
  Prss21_19
gtatagactccagggcgatt

SEQ ID NO: 49687 - DNA, 20 bp, Artificial Sequence
  sgRNA
  Prss21_20
gtttgcgctggcactcctga

SEQ ID NO: 49688 - DNA, 20 bp, Artificial Sequence
  sgRNA
  Prss8_1
ctgcctgtacaacattaatg

SEQ ID NO: 49689 - DNA, 20 bp, Artificial Sequence
  sgRNA
  Prss8_2
atcccgtgacagtacagtga

SEQ ID NO: 49690 - DNA, 20 bp, Artificial Sequence
  sgRNA
  Prss8_3
ctgccaccaccggtgatgcg

SEQ ID NO: 49691 - DNA, 20 bp, Artificial Sequence
  sgRNA
  Prss8_4
gagctgctgcagaggcctag

SEQ ID NO: 49692 - DNA, 20 bp, Artificial Sequence
  sgRNA
  Prss8_5
gatgagcgcgatgtccccct

SEQ ID NO: 49693 - DNA, 20 bp, Artificial Sequence
  sgRNA
  Prss8_6
agaaccgcacactatccagc

SEQ ID NO: 49694 - DNA, 20 bp, Artificial Sequence
  sgRNA
  Prss8_7
gtatactccaggcctgttgg

SEQ ID NO: 49695 - DNA, 20 bp, Artificial Sequence
  sgRNA
  Prss8_8
gctgccgctgagctgaagac

SEQ ID NO: 49696 - DNA, 20 bp, Artificial Sequence
  sgRNA
  Prss8_9
gctcgtgtcaaataaatggg

SEQ ID NO: 49697 - DNA, 20 bp, Artificial Sequence
  sgRNA
  Prss8_10
ggtcgctcgtgtcaaataaa

SEQ ID NO: 49698 - DNA, 20 bp, Artificial Sequence
  sgRNA
  Prss8_11
cactcaagctaccgagaaga

SEQ ID NO: 49699 - DNA, 20 bp, Artificial Sequence
  sgRNA
  Prss8_12
actcaggagtcccagccgga

SEQ ID NO: 49700 - DNA, 20 bp, Artificial Sequence
  sgRNA
  Prss8_13
ggagctctgccacatggtgg

SEQ ID NO: 49701 - DNA, 20 bp, Artificial Sequence
  sgRNA
  Prss8_14
atgtcctgctggatagtgtg

SEQ ID NO: 49702 - DNA, 20 bp, Artificial Sequence
  sgRNA
  Prss8_15
cgagcgacccgccacaaaca

SEQ ID NO: 49703 - DNA, 20 bp, Artificial Sequence
  sgRNA
  Prss8_16
tacgggccttaacaatttcg

SEQ ID NO: 49704 - DNA, 20 bp, Artificial Sequence
  sgRNA
  Prss8_17
ccagactcaggagtcccagc

SEQ ID NO: 49705 - DNA, 20 bp, Artificial Sequence
  sgRNA
  Prss8_18
ccagggtcagaccaagtggc

SEQ ID NO: 49706 - DNA, 20 bp, Artificial Sequence
  sgRNA
  Prss8_19
tgtgctggctatgtgaaggg

SEQ ID NO: 49707 - DNA, 20 bp, Artificial Sequence
  sgRNA
  Prss8_20
gggcccactctcttgtccca

SEQ ID NO: 49708 - DNA, 20 bp, Artificial Sequence
  sgRNA
  Prtg_1
gtgttgcagatctacgacgt

SEQ ID NO: 49709 - DNA, 20 bp, Artificial Sequence
  sgRNA
  Prtg_2
cggctctctatacatcagtg

SEQ ID NO: 49710 - DNA, 20 bp, Artificial Sequence
  sgRNA
  Prtg_3
aaataacgaggaatatcagg

SEQ ID NO: 49711 - DNA, 20 bp, Artificial Sequence
  sgRNA
  Prtg_4
gcttgacatctgatataatg

SEQ ID NO: 49712 - DNA, 20 bp, Artificial Sequence
  sgRNA
  Prtg_5
gatgctgcaccgaagaagca

SEQ ID NO: 49713 - DNA, 20 bp, Artificial Sequence
  sgRNA
  Prtg_6
gacctgatcatcaatagcta

SEQ ID NO: 49714 - DNA, 20 bp, Artificial Sequence
  sgRNA
  Prtg_7
gatctacgacgttggcccgg

SEQ ID NO: 49715 - DNA, 20 bp, Artificial Sequence
  sgRNA
  Prtg_8
ggccattcgacaaatgaagg

SEQ ID NO: 49716 - DNA, 20 bp, Artificial Sequence
  sgRNA
  Prtg_9
agctccacggagtttgaaaa

SEQ ID NO: 49717 - DNA, 20 bp, Artificial Sequence
  sgRNA
  Prtg_10
tcatggacctcagtagacac

SEQ ID NO: 49718 - DNA, 20 bp, Artificial Sequence
  sgRNA
  Prtg_11
ggtcacctttacccctaccg

SEQ ID NO: 49719 - DNA, 20 bp, Artificial Sequence
  sgRNA
  Prtg_12
cgtcggtgtggacctcacac

SEQ ID NO: 49720 - DNA, 20 bp, Artificial Sequence
  sgRNA
  Prtg_13
tgtagccccgaatagcggcc

SEQ ID NO: 49721 - DNA, 20 bp, Artificial Sequence
  sgRNA
  Prtg_14
tgtaagccaggagcctcacg

SEQ ID NO: 49722 - DNA, 20 bp, Artificial Sequence
  sgRNA
  Prtg_15
gccgcctgcagtcataacat

SEQ ID NO: 49723 - DNA, 20 bp, Artificial Sequence
  sgRNA
  Prtg_16
attgtggcgtacatgccgct

SEQ ID NO: 49724 - DNA, 20 bp, Artificial Sequence
  sgRNA
  Prtg_17
aatcccggccaagtaccggc

SEQ ID NO: 49725 - DNA, 20 bp, Artificial Sequence
  sgRNA
  Prtg_18
gggctgcgatatgctgccga

SEQ ID NO: 49726 - DNA, 20 bp, Artificial Sequence
  sgRNA
  Prtg_19
tagatctgcaacactcctga

SEQ ID NO: 49727 - DNA, 20 bp, Artificial Sequence
  sgRNA
  Prtg_20
ctatagtagctgcaacacag

SEQ ID NO: 49728 - DNA, 20 bp, Artificial Sequence
  sgRNA
  Psca_1
gataactgtcacgagtccaa

SEQ ID NO: 49729 - DNA, 20 bp, Artificial Sequence
  sgRNA
  Psca_2
gcgatgtaaagcaactgtgc

SEQ ID NO: 49730 - DNA, 20 bp, Artificial Sequence
  sgRNA
  Psca_3
ctcgtgacagttatcagtaa

SEQ ID NO: 49731 - DNA, 20 bp, Artificial Sequence
  sgRNA
  Psca_4
acctacttagccctgcatcc

SEQ ID NO: 49732 - DNA, 20 bp, Artificial Sequence
  sgRNA
  Psca_5
tgacctgtgcaatgtcaacg

SEQ ID NO: 49733 - DNA, 20 bp, Artificial Sequence
  sgRNA
  Psca_6
tgaagccacccaccaccctg

SEQ ID NO: 49734 - DNA, 20 bp, Artificial Sequence
  sgRNA
  Psca_7
gggccccgttgacattgcac

SEQ ID NO: 49735 - DNA, 20 bp, Artificial Sequence
  sgRNA
  Psca_8
tctgacctgtgcaatgtcaa

SEQ ID NO: 49736 - DNA, 20 bp, Artificial Sequence
  sgRNA
  Psca_9
tggatgcagggctaagtagg

SEQ ID NO: 49737 - DNA, 20 bp, Artificial Sequence
  sgRNA
  Psca_10
gaatgtacagaactgcagcc

SEQ ID NO: 49738 - DNA, 20 bp, Artificial Sequence
  sgRNA
  Psca_11
gagcacggtcagcagcccca

SEQ ID NO: 49739 - DNA, 20 bp, Artificial Sequence
  sgRNA
  Psca_12
ctgacctgtgcaatgtcaac

SEQ ID NO: 49740 - DNA, 20 bp, Artificial Sequence
  sgRNA
  Psca_13
ggccagcaggagaaagaaga

SEQ ID NO: 49741 - DNA, 20 bp, Artificial Sequence
  sgRNA
  Psca_14
ggctggagccccacagcaac

SEQ ID NO: 49742 - DNA, 20 bp, Artificial Sequence
  sgRNA
  Psca_15
cagcaacaggctgcagagca

SEQ ID NO: 49743 - DNA, 20 bp, Artificial Sequence
  sgRNA
  Psca_16
acctggatgcagggctaagt

SEQ ID NO: 49744 - DNA, 20 bp, Artificial Sequence
  sgRNA
  Psca_17
gggctaagtaggtggccagc

SEQ ID NO: 49745 - DNA, 20 bp, Artificial Sequence
  sgRNA
  Psca_18
ctcacagtgtgaggatgact

SEQ ID NO: 49746 - DNA, 20 bp, Artificial Sequence
  sgRNA
  Psca_19
tgactcggagaactactatt

SEQ ID NO: 49747 - DNA, 20 bp, Artificial Sequence
  sgRNA
  Psca_20
ggtcagcagccccagggtgg

SEQ ID NO: 49748 - DNA, 20 bp, Artificial Sequence
  sgRNA
  Psen1_1
tttcaaccagcatacgaagt

SEQ ID NO: 49749 - DNA, 20 bp, Artificial Sequence
  sgRNA
  Psen1_2
tgctactgtaacgtagtcca

SEQ ID NO: 49750 - DNA, 20 bp, Artificial Sequence
  sgRNA
  Psen1_3
ctgagccaatatctaatggg

SEQ ID NO: 49751 - DNA, 20 bp, Artificial Sequence
  sgRNA
  Psen1_4
agtcagcttctatacccgga

SEQ ID NO: 49752 - DNA, 20 bp, Artificial Sequence
  sgRNA
  Psen1_5
gctcgtgttctacttcgcca

SEQ ID NO: 49753 - DNA, 20 bp, Artificial Sequence
  sgRNA
  Psen1_6
tctaacgagtgaagacccgg

SEQ ID NO: 49754 - DNA, 20 bp, Artificial Sequence
  sgRNA
  Psen1_7
atacgcctgctgcagtcgaa

SEQ ID NO: 49755 - DNA, 20 bp, Artificial Sequence
  sgRNA
  Psen1_8
cattatgaccatcctcctgg

SEQ ID NO: 49756 - DNA, 20 bp, Artificial Sequence
  sgRNA
  Psen1_9
gggctgcacaaggtaatccg

SEQ ID NO: 49757 - DNA, 20 bp, Artificial Sequence
  sgRNA
  Psen1_10
acctccccgaatggaccgca

SEQ ID NO: 49758 - DNA, 20 bp, Artificial Sequence
  sgRNA
  Psen1_11
cacgacgacgaccatgcaga

SEQ ID NO: 49759 - DNA, 20 bp, Artificial Sequence
  sgRNA
  Psen1_12
aatcagtcagcttctatacc

SEQ ID NO: 49760 - DNA, 20 bp, Artificial Sequence
  sgRNA
  Psen1_13
agacccagaagcccaaagga

SEQ ID NO: 49761 - DNA, 20 bp, Artificial Sequence
  sgRNA
  Psen1_14
atttatacaggaccaccagg

SEQ ID NO: 49762 - DNA, 20 bp, Artificial Sequence
  sgRNA
  Psen1_15
gagtaactcaagacaggtgg

SEQ ID NO: 49763 - DNA, 20 bp, Artificial Sequence
  sgRNA
  Psen1_16
gtttcaaccagcatacgaag

SEQ ID NO: 49764 - DNA, 20 bp, Artificial Sequence
  sgRNA
  Psen1_17
gatgagccatgcggtccatt

SEQ ID NO: 49765 - DNA, 20 bp, Artificial Sequence
  sgRNA
  Psen1_18
gcaggagtaatgtaaggcac

SEQ ID NO: 49766 - DNA, 20 bp, Artificial Sequence
  sgRNA
  Psen1_19
aatgcaagttggtccatgaa

SEQ ID NO: 49767 - DNA, 20 bp, Artificial Sequence
  sgRNA
  Psen1_20
tgtgttccagtctccactgg

SEQ ID NO: 49768 - DNA, 20 bp, Artificial Sequence
  sgRNA
  Psen2_1
tgtcacgctgtgtatgatcg

SEQ ID NO: 49769 - DNA, 20 bp, Artificial Sequence
  sgRNA
  Psen2_2
gagccccactgcatgcgtag

SEQ ID NO: 49770 - DNA, 20 bp, Artificial Sequence
  sgRNA
  Psen2_3
gatacttgtagagtaccacg

SEQ ID NO: 49771 - DNA, 20 bp, Artificial Sequence
  sgRNA
  Psen2_4
agtgctcaagacctacaatg

SEQ ID NO: 49772 - DNA, 20 bp, Artificial Sequence
  sgRNA
  Psen2_5
ggtgttcatcaagtacctgc

SEQ ID NO: 49773 - DNA, 20 bp, Artificial Sequence
  sgRNA
  Psen2_6
catctacacgcccttcacgg

SEQ ID NO: 49774 - DNA, 20 bp, Artificial Sequence
  sgRNA
  Psen2_7
gttccagtctccgttgccag

SEQ ID NO: 49775 - DNA, 20 bp, Artificial Sequence
  sgRNA
  Psen2_8
atgcttcgccccatacttga

SEQ ID NO: 49776 - DNA, 20 bp, Artificial Sequence
  sgRNA
  Psen2_9
gcagcgctccttgagaggag

SEQ ID NO: 49777 - DNA, 20 bp, Artificial Sequence
  sgRNA
  Psen2_10
gctgcttgctgtgttcaaga

SEQ ID NO: 49778 - DNA, 20 bp, Artificial Sequence
  sgRNA
  Psen2_11
agtcatgaccatcttcctcg

SEQ ID NO: 49779 - DNA, 20 bp, Artificial Sequence
  sgRNA
  Psen2_12
catcttctacagcgtcctgg

SEQ ID NO: 49780 - DNA, 20 bp, Artificial Sequence
  sgRNA
  Psen2_13
tggccgtgctgtgccccaaa

SEQ ID NO: 49781 - DNA, 20 bp, Artificial Sequence
  sgRNA
  Psen2_14
tgagtgcgctgatcacaata

SEQ ID NO: 49782 - DNA, 20 bp, Artificial Sequence
  sgRNA
  Psen2_15
gtttccaccagcatcctcag

SEQ ID NO: 49783 - DNA, 20 bp, Artificial Sequence
  sgRNA
  Psen2_16
gctgtgtatgatcgtggtgg

SEQ ID NO: 49784 - DNA, 20 bp, Artificial Sequence
  sgRNA
  Psen2_17
tgtagaagatgaagtctccc

SEQ ID NO: 49785 - DNA, 20 bp, Artificial Sequence
  sgRNA
  Psen2_18
tcgaaggcttcagggtatga

SEQ ID NO: 49786 - DNA, 20 bp, Artificial Sequence
  sgRNA
  Psen2_19
gatgacgctgatcatgatga

SEQ ID NO: 49787 - DNA, 20 bp, Artificial Sequence
  sgRNA
  Psen2_20
gggttctccaaaactgtcgt

SEQ ID NO: 49788 - DNA, 20 bp, Artificial Sequence
  sgRNA
  Psg16_1
ctacggaccgtaaatagacg

SEQ ID NO: 49789 - DNA, 20 bp, Artificial Sequence
  sgRNA
  Psg16_2
agggctttcctggtacaaag

SEQ ID NO: 49790 - DNA, 20 bp, Artificial Sequence
  sgRNA
  Psg16_3
tacaaactctgagtagacat

SEQ ID NO: 49791 - DNA, 20 bp, Artificial Sequence
  sgRNA
  Psg16_4
tcatcatcgatccaatgcca

SEQ ID NO: 49792 - DNA, 20 bp, Artificial Sequence
  sgRNA
  Psg16_5
cttcaggcagattaagaaca

SEQ ID NO: 49793 - DNA, 20 bp, Artificial Sequence
  sgRNA
  Psg16_6
acgtctatttacggtccgta

SEQ ID NO: 49794 - DNA, 20 bp, Artificial Sequence
  sgRNA
  Psg16_7
tccccttctgcagcataccg

SEQ ID NO: 49795 - DNA, 20 bp, Artificial Sequence
  sgRNA
  Psg16_8
cagggggtacaccccttgca

SEQ ID NO: 49796 - DNA, 20 bp, Artificial Sequence
  sgRNA
  Psg16_9
cattggatcgatgatgagtt

SEQ ID NO: 49797 - DNA, 20 bp, Artificial Sequence
  sgRNA
  Psg16_10
gagccagcaggctaaaaggg

SEQ ID NO: 49798 - DNA, 20 bp, Artificial Sequence
  sgRNA
  Psg16_11
aggaaacaactgacaccatg

SEQ ID NO: 49799 - DNA, 20 bp, Artificial Sequence
  sgRNA
  Psg16_12
tctgcagcataccgtggcat

SEQ ID NO: 49800 - DNA, 20 bp, Artificial Sequence
  sgRNA
  Psg16_13
ccaggaactccatcaccaag

SEQ ID NO: 49801 - DNA, 20 bp, Artificial Sequence
  sgRNA
  Psg16_14
gtcacagcatgaagaaaggg

SEQ ID NO: 49802 - DNA, 20 bp, Artificial Sequence
  sgRNA
  Psg16_15
tgtggatccacaatgtcacc

SEQ ID NO: 49803 - DNA, 20 bp, Artificial Sequence
  sgRNA
  Psg16_16
tctccttcaaccacattgaa

SEQ ID NO: 49804 - DNA, 20 bp, Artificial Sequence
  sgRNA
  Psg16_17
atgtctactcagagtttgta

SEQ ID NO: 49805 - DNA, 20 bp, Artificial Sequence
  sgRNA
  Psg16_18
ggtgacattgtggatccaca

SEQ ID NO: 49806 - DNA, 20 bp, Artificial Sequence
  sgRNA
  Psg16_19
ttatctgtcgggcaatctca

SEQ ID NO: 49807 - DNA, 20 bp, Artificial Sequence
  sgRNA
  Psg16_20
gctgtctgtgactctcatga

SEQ ID NO: 49808 - DNA, 20 bp, Artificial Sequence
  sgRNA
  Psg17_1
aatggatcgatactgagctg

SEQ ID NO: 49809 - DNA, 20 bp, Artificial Sequence
  sgRNA
  Psg17_2
ggcactaattcaatagtggg

SEQ ID NO: 49810 - DNA, 20 bp, Artificial Sequence
  sgRNA
  Psg17_3
cttcgaaccgtaagtcaacg

SEQ ID NO: 49811 - DNA, 20 bp, Artificial Sequence
  sgRNA
  Psg17_4
aatataatgtaagtgtgaca

SEQ ID NO: 49812 - DNA, 20 bp, Artificial Sequence
  sgRNA
  Psg17_5
acgttgacttacggttcgaa

SEQ ID NO: 49813 - DNA, 20 bp, Artificial Sequence
  sgRNA
  Psg17_6
gacagcacagtacgagtaca

SEQ ID NO: 49814 - DNA, 20 bp, Artificial Sequence
  sgRNA
  Psg17_7
ccatcatcatgggctatgca

SEQ ID NO: 49815 - DNA, 20 bp, Artificial Sequence
  sgRNA
  Psg17_8
gtgacagggcttaagcacag

SEQ ID NO: 49816 - DNA, 20 bp, Artificial Sequence
  sgRNA
  Psg17_9
ttcaatagtgggaggtacaa

SEQ ID NO: 49817 - DNA, 20 bp, Artificial Sequence
  sgRNA
  Psg17_10
gcaacgaagtccatcatcat

SEQ ID NO: 49818 - DNA, 20 bp, Artificial Sequence
  sgRNA
  Psg17_11
gtaatatcctgtgtcctccg

SEQ ID NO: 49819 - DNA, 20 bp, Artificial Sequence
  sgRNA
  Psg17_12
gtggatccaaaatgtcacct

SEQ ID NO: 49820 - DNA, 20 bp, Artificial Sequence
  sgRNA
  Psg17_13
gtgacagcacgaggaaaggg

SEQ ID NO: 49821 - DNA, 20 bp, Artificial Sequence
  sgRNA
  Psg17_14
ggaattcttacctccccaag

SEQ ID NO: 49822 - DNA, 20 bp, Artificial Sequence
  sgRNA
  Psg17_15
ataacaacagacagcaatat

SEQ ID NO: 49823 - DNA, 20 bp, Artificial Sequence
  sgRNA
  Psg17_16
caatggatcgatactgagct

SEQ ID NO: 49824 - DNA, 20 bp, Artificial Sequence
  sgRNA
  Psg17_17
tgcccacagcggtagagaaa

SEQ ID NO: 49825 - DNA, 20 bp, Artificial Sequence
  sgRNA
  Psg17_18
gatccaaaatgtcacctcgg

SEQ ID NO: 49826 - DNA, 20 bp, Artificial Sequence
  sgRNA
  Psg17_19
gcatgctgctgaagggggaa

SEQ ID NO: 49827 - DNA, 20 bp, Artificial Sequence
  sgRNA
  Psg17_20
agagaaacggtgttcagcaa

SEQ ID NO: 49828 - DNA, 20 bp, Artificial Sequence
  sgRNA
  Psg18_1
gtgaaggggctgaatcacag

SEQ ID NO: 49829 - DNA, 20 bp, Artificial Sequence
  sgRNA
  Psg18_2
tttcaaaccataagtaaacg

SEQ ID NO: 49830 - DNA, 20 bp, Artificial Sequence
  sgRNA
  Psg18_3
agggctgattgcatttaaca

SEQ ID NO: 49831 - DNA, 20 bp, Artificial Sequence
  sgRNA
  Psg18_4
ttaccaccccaagtgtatga

SEQ ID NO: 49832 - DNA, 20 bp, Artificial Sequence
  sgRNA
  Psg18_5
gctggcactaattcaatagt

SEQ ID NO: 49833 - DNA, 20 bp, Artificial Sequence
  sgRNA
  Psg18_6
gctgtactactatagtgtaa

SEQ ID NO: 49834 - DNA, 20 bp, Artificial Sequence
  sgRNA
  Psg18_7
cctccctcagcagcgtgccg

SEQ ID NO: 49835 - DNA, 20 bp, Artificial Sequence
  sgRNA
  Psg18_8
tctccttcatacacttgggg

SEQ ID NO: 49836 - DNA, 20 bp, Artificial Sequence
  sgRNA
  Psg18_9
acgcacacagatgaaaagag

SEQ ID NO: 49837 - DNA, 20 bp, Artificial Sequence
  sgRNA
  Psg18_10
ggcaagcaattgcacagcat

SEQ ID NO: 49838 - DNA, 20 bp, Artificial Sequence
  sgRNA
  Psg18_11
cagaacagccaagaattcag

SEQ ID NO: 49839 - DNA, 20 bp, Artificial Sequence
  sgRNA
  Psg18_12
gaacctggtccggcccacag

SEQ ID NO: 49840 - DNA, 20 bp, Artificial Sequence
  sgRNA
  Psg18_13
gtcacagcacaaggaatggg

SEQ ID NO: 49841 - DNA, 20 bp, Artificial Sequence
  sgRNA
  Psg18_14
ccagccagcgttgctgcagg

SEQ ID NO: 49842 - DNA, 20 bp, Artificial Sequence
  sgRNA
  Psg18_15
agcgtcttcagctcacagag

SEQ ID NO: 49843 - DNA, 20 bp, Artificial Sequence
  sgRNA
  Psg18_16
agtgtcacagcacaaggaat

SEQ ID NO: 49844 - DNA, 20 bp, Artificial Sequence
  sgRNA
  Psg18_17
tcagcattgatccagtgcca

SEQ ID NO: 49845 - DNA, 20 bp, Artificial Sequence
  sgRNA
  Psg18_18
ttcaatagtcggagatataa

SEQ ID NO: 49846 - DNA, 20 bp, Artificial Sequence
  sgRNA
  Psg18_19
agagagacagtgtatagcaa

SEQ ID NO: 49847 - DNA, 20 bp, Artificial Sequence
  sgRNA
  Psg18_20
aatgtcacacaagaggacac

SEQ ID NO: 49848 - DNA, 20 bp, Artificial Sequence
  sgRNA
  Psg19_1
tctccttcgaccaatttggg

SEQ ID NO: 49849 - DNA, 20 bp, Artificial Sequence
  sgRNA
  Psg19_2
gttgaaagcgtcacagcacg

SEQ ID NO: 49850 - DNA, 20 bp, Artificial Sequence
  sgRNA
  Psg19_3
gtgacaggacctgagcacag

SEQ ID NO: 49851 - DNA, 20 bp, Artificial Sequence
  sgRNA
  Psg19_4
gaaatgggccctgcccacag

SEQ ID NO: 49852 - DNA, 20 bp, Artificial Sequence
  sgRNA
  Psg19_5
tgtggatccaaagtgccacc

SEQ ID NO: 49853 - DNA, 20 bp, Artificial Sequence
  sgRNA
  Psg19_6
atatcctgtgtcttcccggg

SEQ ID NO: 49854 - DNA, 20 bp, Artificial Sequence
  sgRNA
  Psg19_7
ggtggcactttggatccaca

SEQ ID NO: 49855 - DNA, 20 bp, Artificial Sequence
  sgRNA
  Psg19_8
agaatcttcgagtctttgcc

SEQ ID NO: 49856 - DNA, 20 bp, Artificial Sequence
  sgRNA
  Psg19_9
aatgtcacctggaaggacat

SEQ ID NO: 49857 - DNA, 20 bp, Artificial Sequence
  sgRNA
  Psg19_10
gtaccacccaaattggtcga

SEQ ID NO: 49858 - DNA, 20 bp, Artificial Sequence
  sgRNA
  Psg19_11
ctttctcagtgacatcctgg

SEQ ID NO: 49859 - DNA, 20 bp, Artificial Sequence
  sgRNA
  Psg19_12
agtctttgcctggtacagag

SEQ ID NO: 49860 - DNA, 20 bp, Artificial Sequence
  sgRNA
  Psg19_13
gagtctttgcctggtacaga

SEQ ID NO: 49861 - DNA, 20 bp, Artificial Sequence
  sgRNA
  Psg19_14
ggggtaataaaatttaagct

SEQ ID NO: 49862 - DNA, 20 bp, Artificial Sequence
  sgRNA
  Psg19_15
agtgccacccgggaagacac

SEQ ID NO: 49863 - DNA, 20 bp, Artificial Sequence
  sgRNA
  Psg19_16
tccccttcgacagcatgtgg

SEQ ID NO: 49864 - DNA, 20 bp, Artificial Sequence
  sgRNA
  Psg19_17
agtgacatcctggaggagca

SEQ ID NO: 49865 - DNA, 20 bp, Artificial Sequence
  sgRNA
  Psg19_18
gccaccacatgctgtcgaag

SEQ ID NO: 49866 - DNA, 20 bp, Artificial Sequence
  sgRNA
  Psg19_19
ctttccccttcgacagcatg

SEQ ID NO: 49867 - DNA, 20 bp, Artificial Sequence
  sgRNA
  Psg19_20
gtgacagagtctatcatcag

SEQ ID NO: 49868 - DNA, 20 bp, Artificial Sequence
  sgRNA
  Psg20_1
cagaggactgagaaattgga

SEQ ID NO: 49869 - DNA, 20 bp, Artificial Sequence
  sgRNA
  Psg20_2
gcttctgtccaccactgcca

SEQ ID NO: 49870 - DNA, 20 bp, Artificial Sequence
  sgRNA
  Psg20_3
acgagttgacaatctgccag

SEQ ID NO: 49871 - DNA, 20 bp, Artificial Sequence
  sgRNA
  Psg20_4
attgctgagaagaagctcag

SEQ ID NO: 49872 - DNA, 20 bp, Artificial Sequence
  sgRNA
  Psg20_5
tgtccttcaaccacttggag

SEQ ID NO: 49873 - DNA, 20 bp, Artificial Sequence
  sgRNA
  Psg20_6
agtataatgcaagtatgaca

SEQ ID NO: 49874 - DNA, 20 bp, Artificial Sequence
  sgRNA
  Psg20_7
cacacagcagaagagagaca

SEQ ID NO: 49875 - DNA, 20 bp, Artificial Sequence
  sgRNA
  Psg20_8
tgccgcccagagttgctgaa

SEQ ID NO: 49876 - DNA, 20 bp, Artificial Sequence
  sgRNA
  Psg20_9
gcactgtttcaactttcaca

SEQ ID NO: 49877 - DNA, 20 bp, Artificial Sequence
  sgRNA
  Psg20_10
tatccattcaccgctccaag

SEQ ID NO: 49878 - DNA, 20 bp, Artificial Sequence
  sgRNA
  Psg20_11
tgacatgtcatgctgctgaa

SEQ ID NO: 49879 - DNA, 20 bp, Artificial Sequence
  sgRNA
  Psg20_12
cccccttcagcaactctggg

SEQ ID NO: 49880 - DNA, 20 bp, Artificial Sequence
  sgRNA
  Psg20_13
atggatagtgaccttggcag

SEQ ID NO: 49881 - DNA, 20 bp, Artificial Sequence
  sgRNA
  Psg20_14
cagaagccagcaggtaaaga

SEQ ID NO: 49882 - DNA, 20 bp, Artificial Sequence
  sgRNA
  Psg20_15
aattagcacacatttacctt

SEQ ID NO: 49883 - DNA, 20 bp, Artificial Sequence
  sgRNA
  Psg20_16
ttcaatagtgagcttggcag

SEQ ID NO: 49884 - DNA, 20 bp, Artificial Sequence
  sgRNA
  Psg20_17
acgcccacaggtgaaaagag

SEQ ID NO: 49885 - DNA, 20 bp, Artificial Sequence
  sgRNA
  Psg20_18
tcagcagcatgacatgtcac

SEQ ID NO: 49886 - DNA, 20 bp, Artificial Sequence
  sgRNA
  Psg20_19
ctgagcttcttctcagcaat

SEQ ID NO: 49887 - DNA, 20 bp, Artificial Sequence
  sgRNA
  Psg20_20
gcaaaagctagaagatcctc

SEQ ID NO: 49888 - DNA, 20 bp, Artificial Sequence
  sgRNA
  Psg21_1
ctggatggtgacactagcag

SEQ ID NO: 49889 - DNA, 20 bp, Artificial Sequence
  sgRNA
  Psg21_2
atcacttactctccacctga

SEQ ID NO: 49890 - DNA, 20 bp, Artificial Sequence
  sgRNA
  Psg21_3
acagaggactgataaattgg

SEQ ID NO: 49891 - DNA, 20 bp, Artificial Sequence
  sgRNA
  Psg21_4
aattcttgagtgttctgtgc

SEQ ID NO: 49892 - DNA, 20 bp, Artificial Sequence
  sgRNA
  Psg21_5
acgcccacaggtgaaatgag

SEQ ID NO: 49893 - DNA, 20 bp, Artificial Sequence
  sgRNA
  Psg21_6
tttcaaaccataagtaacca

SEQ ID NO: 49894 - DNA, 20 bp, Artificial Sequence
  sgRNA
  Psg21_7
ggtacagaggactgataaat

SEQ ID NO: 49895 - DNA, 20 bp, Artificial Sequence
  sgRNA
  Psg21_8
tcaccaaaacacgtagttga

SEQ ID NO: 49896 - DNA, 20 bp, Artificial Sequence
  sgRNA
  Psg21_9
atggatccaaaatgtcaccc

SEQ ID NO: 49897 - DNA, 20 bp, Artificial Sequence
  sgRNA
  Psg21_10
atttatcagtcctctgtacc

SEQ ID NO: 49898 - DNA, 20 bp, Artificial Sequence
  sgRNA
  Psg21_11
cgtcctccttcagcaactct

SEQ ID NO: 49899 - DNA, 20 bp, Artificial Sequence
  sgRNA
  Psg21_12
gcgtcctccttcagcaactc

SEQ ID NO: 49900 - DNA, 20 bp, Artificial Sequence
  sgRNA
  Psg21_13
tctccttcaactacgtgttt

SEQ ID NO: 49901 - DNA, 20 bp, Artificial Sequence
  sgRNA
  Psg21_14
aaatacgtccacatttcttc

SEQ ID NO: 49902 - DNA, 20 bp, Artificial Sequence
  sgRNA
  Psg22_1
gtgaatacaatgcaattccg

SEQ ID NO: 49903 - DNA, 20 bp, Artificial Sequence
  sgRNA
  Psg22_2
gaagattatctggaagactg

SEQ ID NO: 49904 - DNA, 20 bp, Artificial Sequence
  sgRNA
  Psg22_3
gttgaaatcgtcacagcacg

SEQ ID NO: 49905 - DNA, 20 bp, Artificial Sequence
  sgRNA
  Psg22_4
gctgctccagaatgtcacct

SEQ ID NO: 49906 - DNA, 20 bp, Artificial Sequence
  sgRNA
  Psg22_5
gacagcacagttcgaataca

SEQ ID NO: 49907 - DNA, 20 bp, Artificial Sequence
  sgRNA
  Psg22_6
tgtggatccaaaatgtcacc

SEQ ID NO: 49908 - DNA, 20 bp, Artificial Sequence
  sgRNA
  Psg22_7
gaaatgggccctgcctacag

SEQ ID NO: 49909 - DNA, 20 bp, Artificial Sequence
  sgRNA
  Psg22_8
tctccttcaaccaatttggg

SEQ ID NO: 49910 - DNA, 20 bp, Artificial Sequence
  sgRNA
  Psg22_9
gttcacattgacttgcacat

SEQ ID NO: 49911 - DNA, 20 bp, Artificial Sequence
  sgRNA
  Psg22_10
actgtactggcctttctcag

SEQ ID NO: 49912 - DNA, 20 bp, Artificial Sequence
  sgRNA
  Psg22_11
gtgacaggacctaagcacag

SEQ ID NO: 49913 - DNA, 20 bp, Artificial Sequence
  sgRNA
  Psg22_12
atatctgttcacaatttgta

SEQ ID NO: 49914 - DNA, 20 bp, Artificial Sequence
  sgRNA
  Psg22_13
gtaccacccaaattggttga

SEQ ID NO: 49915 - DNA, 20 bp, Artificial Sequence
  sgRNA
  Psg22_14
gagtctttgtctggtataga

SEQ ID NO: 49916 - DNA, 20 bp, Artificial Sequence
  sgRNA
  Psg22_15
agaagaactttgctcctgca

SEQ ID NO: 49917 - DNA, 20 bp, Artificial Sequence
  sgRNA
  Psg22_16
tgtacagaaacgggtccctg

SEQ ID NO: 49918 - DNA, 20 bp, Artificial Sequence
  sgRNA
  Psg22_17
gcatgctgctgaaggggaaa

SEQ ID NO: 49919 - DNA, 20 bp, Artificial Sequence
  sgRNA
  Psg22_18
atcaatggctatgcacacag

SEQ ID NO: 49920 - DNA, 20 bp, Artificial Sequence
  sgRNA
  Psg22_19
gtagaatcctgtgtcttccc

SEQ ID NO: 49921 - DNA, 20 bp, Artificial Sequence
  sgRNA
  Psg22_20
agtctttgtctggtatagag

SEQ ID NO: 49922 - DNA, 20 bp, Artificial Sequence
  sgRNA
  Psg23_1
tctccttcaactacgtgttg

SEQ ID NO: 49923 - DNA, 20 bp, Artificial Sequence
  sgRNA
  Psg23_2
aggggtgattatgattcaca

SEQ ID NO: 49924 - DNA, 20 bp, Artificial Sequence
  sgRNA
  Psg23_3
acagtagacctgaagaaatg

SEQ ID NO: 49925 - DNA, 20 bp, Artificial Sequence
  sgRNA
  Psg23_4
acagaggactgacaaattgg

SEQ ID NO: 49926 - DNA, 20 bp, Artificial Sequence
  sgRNA
  Psg23_5
cctgagttgacactttgacg

SEQ ID NO: 49927 - DNA, 20 bp, Artificial Sequence
  sgRNA
  Psg23_6
atatcgattcacagtttgta

SEQ ID NO: 49928 - DNA, 20 bp, Artificial Sequence
  sgRNA
  Psg23_7
ggtacagaggactgacaaat

SEQ ID NO: 49929 - DNA, 20 bp, Artificial Sequence
  sgRNA
  Psg23_8
cctccttcagcaacgctggg

SEQ ID NO: 49930 - DNA, 20 bp, Artificial Sequence
  sgRNA
  Psg23_9
agactggtcttagagttggc

SEQ ID NO: 49931 - DNA, 20 bp, Artificial Sequence
  sgRNA
  Psg23_10
aattcttgagtgttctgtac

SEQ ID NO: 49932 - DNA, 20 bp, Artificial Sequence
  sgRNA
  Psg23_11
aatatcgattcacagtttgt

SEQ ID NO: 49933 - DNA, 20 bp, Artificial Sequence
  sgRNA
  Psg23_12
cttcaaaccataagtaacca

SEQ ID NO: 49934 - DNA, 20 bp, Artificial Sequence
  sgRNA
  Psg23_13
cttcctccttcagcaacgct

SEQ ID NO: 49935 - DNA, 20 bp, Artificial Sequence
  sgRNA
  Psg23_14
gactggtcttagagttggct

SEQ ID NO: 49936 - DNA, 20 bp, Artificial Sequence
  sgRNA
  Psg23_15
tgtgaatcgatattggaaaa

SEQ ID NO: 49937 - DNA, 20 bp, Artificial Sequence
  sgRNA
  Psg23_16
atcctgagttgacactttga

SEQ ID NO: 49938 - DNA, 20 bp, Artificial Sequence
  sgRNA
  Psg23_17
gtttccgagactctcatgac

SEQ ID NO: 49939 - DNA, 20 bp, Artificial Sequence
  sgRNA
  Psg23_18
acagcctgtcatgagagtct

SEQ ID NO: 49940 - DNA, 20 bp, Artificial Sequence
  sgRNA
  Psg23_19
catactgtgaggaaggagga

SEQ ID NO: 49941 - DNA, 20 bp, Artificial Sequence
  sgRNA
  Psg23_20
tacgtgttgtggtgactgga

SEQ ID NO: 49942 - DNA, 20 bp, Artificial Sequence
  sgRNA
  Psg25_1
cccccttcgacagcataccg

SEQ ID NO: 49943 - DNA, 20 bp, Artificial Sequence
  sgRNA
  Psg25_2
gtgtccacagatgaaagtag

SEQ ID NO: 49944 - DNA, 20 bp, Artificial Sequence
  sgRNA
  Psg25_3
gtgactggacctgagcacag

SEQ ID NO: 49945 - DNA, 20 bp, Artificial Sequence
  sgRNA
  Psg25_4
taaagaatggatgatgactc

SEQ ID NO: 49946 - DNA, 20 bp, Artificial Sequence
  sgRNA
  Psg25_5
ccattctttaccactccaag

SEQ ID NO: 49947 - DNA, 20 bp, Artificial Sequence
  sgRNA
  Psg25_6
gagccaggtcatgctcacag

SEQ ID NO: 49948 - DNA, 20 bp, Artificial Sequence
  sgRNA
  Psg25_7
taggccttgcctggtacaga

SEQ ID NO: 49949 - DNA, 20 bp, Artificial Sequence
  sgRNA
  Psg25_8
ccacttggagtggtaaagaa

SEQ ID NO: 49950 - DNA, 20 bp, Artificial Sequence
  sgRNA
  Psg25_9
cttgcttctcagacaacacc

SEQ ID NO: 49951 - DNA, 20 bp, Artificial Sequence
  sgRNA
  Psg25_10
tgccacggtatgctgtcgaa

SEQ ID NO: 49952 - DNA, 20 bp, Artificial Sequence
  sgRNA
  Psg25_11
atggatgatgactctggcag

SEQ ID NO: 49953 - DNA, 20 bp, Artificial Sequence
  sgRNA
  Psg25_12
gtatcacagcacaaggaaag

SEQ ID NO: 49954 - DNA, 20 bp, Artificial Sequence
  sgRNA
  Psg25_13
gcgacgaagtccatcatcag

SEQ ID NO: 49955 - DNA, 20 bp, Artificial Sequence
  sgRNA
  Psg25_14
agagagatagggtacaccga

SEQ ID NO: 49956 - DNA, 20 bp, Artificial Sequence
  sgRNA
  Psg25_15
ggtgacatcctgaagcagca

SEQ ID NO: 49957 - DNA, 20 bp, Artificial Sequence
  sgRNA
  Psg25_16
gggttgctaaatttgaaact

SEQ ID NO: 49958 - DNA, 20 bp, Artificial Sequence
  sgRNA
  Psg25_17
gagccagtaggttaagatgg

SEQ ID NO: 49959 - DNA, 20 bp, Artificial Sequence
  sgRNA
  Psg25_18
agtgtgtacctcctggcaga

SEQ ID NO: 49960 - DNA, 20 bp, Artificial Sequence
  sgRNA
  Psg25_19
acaccaggatctccatccgt

SEQ ID NO: 49961 - DNA, 20 bp, Artificial Sequence
  sgRNA
  Psg25_20
ctaccactgtgagcatgacc

SEQ ID NO: 49962 - DNA, 20 bp, Artificial Sequence
  sgRNA
  Psg26_1
gaatctggtccagcccacag

SEQ ID NO: 49963 - DNA, 20 bp, Artificial Sequence
  sgRNA
  Psg26_2
tatacatcaacgggaccctg

SEQ ID NO: 49964 - DNA, 20 bp, Artificial Sequence
  sgRNA
  Psg26_3
caggtccataatctgccaga

SEQ ID NO: 49965 - DNA, 20 bp, Artificial Sequence
  sgRNA
  Psg26_4
tgaatccttaccaccccaag

SEQ ID NO: 49966 - DNA, 20 bp, Artificial Sequence
  sgRNA
  Psg26_5
ttcgctgtactatagtgtaa

SEQ ID NO: 49967 - DNA, 20 bp, Artificial Sequence
  sgRNA
  Psg26_6
cccattgctgaaaagttcag

SEQ ID NO: 49968 - DNA, 20 bp, Artificial Sequence
  sgRNA
  Psg26_7
ggtgacatcctggagcagca

SEQ ID NO: 49969 - DNA, 20 bp, Artificial Sequence
  sgRNA
  Psg26_8
gtgaaggggctgaagcacag

SEQ ID NO: 49970 - DNA, 20 bp, Artificial Sequence
  sgRNA
  Psg26_9
actatagtgtaacggtgaag

SEQ ID NO: 49971 - DNA, 20 bp, Artificial Sequence
  sgRNA
  Psg26_10
agagtttgcagctcacagag

SEQ ID NO: 49972 - DNA, 20 bp, Artificial Sequence
  sgRNA
  Psg26_11
gggcgtcctactacacttgt

SEQ ID NO: 49973 - DNA, 20 bp, Artificial Sequence
  sgRNA
  Psg26_12
gtacaagccagagtctttct

SEQ ID NO: 49974 - DNA, 20 bp, Artificial Sequence
  sgRNA
  Psg26_13
gtgggacctacaagtgtagt

SEQ ID NO: 49975 - DNA, 20 bp, Artificial Sequence
  sgRNA
  Psg26_14
acgcccacagatgaaaagag

SEQ ID NO: 49976 - DNA, 20 bp, Artificial Sequence
  sgRNA
  Psg26_15
cttgcttctcatacaacact

SEQ ID NO: 49977 - DNA, 20 bp, Artificial Sequence
  sgRNA
  Psg26_16
gatgtcaccgagaaagactc

SEQ ID NO: 49978 - DNA, 20 bp, Artificial Sequence
  sgRNA
  Psg26_17
gtactatagtgtaacggtga

SEQ ID NO: 49979 - DNA, 20 bp, Artificial Sequence
  sgRNA
  Psg26_18
agtggtgggcaggaaccagc

SEQ ID NO: 49980 - DNA, 20 bp, Artificial Sequence
  sgRNA
  Psg26_19
tgggtgtacctcctggcaga

SEQ ID NO: 49981 - DNA, 20 bp, Artificial Sequence
  sgRNA
  Psg26_20
acactgggatctccatccgt

SEQ ID NO: 49982 - DNA, 20 bp, Artificial Sequence
  sgRNA
  Psg27_1
aggggtgattatgactaaca

SEQ ID NO: 49983 - DNA, 20 bp, Artificial Sequence
  sgRNA
  Psg27_2
actataacacaagtatgaca

SEQ ID NO: 49984 - DNA, 20 bp, Artificial Sequence
  sgRNA
  Psg27_3
tgactcgggcagtagtggag

SEQ ID NO: 49985 - DNA, 20 bp, Artificial Sequence
  sgRNA
  Psg27_4
tcaggatcgatccagtgact

SEQ ID NO: 49986 - DNA, 20 bp, Artificial Sequence
  sgRNA
  Psg27_5
tgtacagcaatggatcccta

SEQ ID NO: 49987 - DNA, 20 bp, Artificial Sequence
  sgRNA
  Psg27_6
gtatgattggccaatgagca

SEQ ID NO: 49988 - DNA, 20 bp, Artificial Sequence
  sgRNA
  Psg27_7
tgactcggcatgctactgaa

SEQ ID NO: 49989 - DNA, 20 bp, Artificial Sequence
  sgRNA
  Psg27_8
atatcgattcagagtttgta

SEQ ID NO: 49990 - DNA, 20 bp, Artificial Sequence
  sgRNA
  Psg27_9
gatccaaaatgtcaccaagg

SEQ ID NO: 49991 - DNA, 20 bp, Artificial Sequence
  sgRNA
  Psg27_10
gagtcaagagtgtcacagca

SEQ ID NO: 49992 - DNA, 20 bp, Artificial Sequence
  sgRNA
  Psg27_11
cttcgaaccataagcaaaca

SEQ ID NO: 49993 - DNA, 20 bp, Artificial Sequence
  sgRNA
  Psg27_12
catacagcagaagagagatt

SEQ ID NO: 49994 - DNA, 20 bp, Artificial Sequence
  sgRNA
  Psg27_13
tcagtagcatgccgagtcac

SEQ ID NO: 49995 - DNA, 20 bp, Artificial Sequence
  sgRNA
  Psg27_14
agtcaaatcctggagcagca

SEQ ID NO: 49996 - DNA, 20 bp, Artificial Sequence
  sgRNA
  Psg27_15
gcgcccacaggtgaaatgag

SEQ ID NO: 49997 - DNA, 20 bp, Artificial Sequence
  sgRNA
  Psg27_16
agaggagccagcaggtaaag

SEQ ID NO: 49998 - DNA, 20 bp, Artificial Sequence
  sgRNA
  Psg27_17
agtagtggagaggagccagc

SEQ ID NO: 49999 - DNA, 20 bp, Artificial Sequence
  sgRNA
  Psg27_18
tacaaactctgaatcgatat

SEQ ID NO: 50000 - DNA, 20 bp, Artificial Sequence
  sgRNA
  Psg27_19
catccattcaccgctccaag

SEQ ID NO: 50001 - DNA, 20 bp, Artificial Sequence
  sgRNA
  Psg27_20
gaggagccagcaggtaaaga

SEQ ID NO: 50002 - DNA, 20 bp, Artificial Sequence
  sgRNA
  Psg28_1
actatagtttaacagcgaag

SEQ ID NO: 50003 - DNA, 20 bp, Artificial Sequence
  sgRNA
  Psg28_2
gaacctggtcctgcccacag

SEQ ID NO: 50004 - DNA, 20 bp, Artificial Sequence
  sgRNA
  Psg28_3
caggtctataatctgccaga

SEQ ID NO: 50005 - DNA, 20 bp, Artificial Sequence
  sgRNA
  Psg28_4
ccgaccagcgttgctgcagg

SEQ ID NO: 50006 - DNA, 20 bp, Artificial Sequence
  sgRNA
  Psg28_5
tactatagtttaacagcgaa

SEQ ID NO: 50007 - DNA, 20 bp, Artificial Sequence
  sgRNA
  Psg28_6
ttcaatagtgggaccttcaa

SEQ ID NO: 50008 - DNA, 20 bp, Artificial Sequence
  sgRNA
  Psg28_7
gtactatagtttaacagcga

SEQ ID NO: 50009 - DNA, 20 bp, Artificial Sequence
  sgRNA
  Psg28_8
gtgccagcaggttaagagga

SEQ ID NO: 50010 - DNA, 20 bp, Artificial Sequence
  sgRNA
  Psg28_9
ggtgacattcttgagcagca

SEQ ID NO: 50011 - DNA, 20 bp, Artificial Sequence
  sgRNA
  Psg28_10
gcaggtgccagcaggttaag

SEQ ID NO: 50012 - DNA, 20 bp, Artificial Sequence
  sgRNA
  Psg28_11
gcgaaggggctgaagcacag

SEQ ID NO: 50013 - DNA, 20 bp, Artificial Sequence
  sgRNA
  Psg28_12
tgaatcctttccaccccaag

SEQ ID NO: 50014 - DNA, 20 bp, Artificial Sequence
  sgRNA
  Psg28_13
acactggaatctccatccgt

SEQ ID NO: 50015 - DNA, 20 bp, Artificial Sequence
  sgRNA
  Psg28_14
tcgcccacagatgaaaagag

SEQ ID NO: 50016 - DNA, 20 bp, Artificial Sequence
  sgRNA
  Psg28_15
tgctgctcaagaatgtcacc

SEQ ID NO: 50017 - DNA, 20 bp, Artificial Sequence
  sgRNA
  Psg28_16
ccccctgcagcaacgctggt

SEQ ID NO: 50018 - DNA, 20 bp, Artificial Sequence
  sgRNA
  Psg28_17
ggtcggcactaattcaatag

SEQ ID NO: 50019 - DNA, 20 bp, Artificial Sequence
  sgRNA
  Psg28_18
atactgtctctctaccactg

SEQ ID NO: 50020 - DNA, 20 bp, Artificial Sequence
  sgRNA
  Psg28_19
taggagaaccctctgccagg

SEQ ID NO: 50021 - DNA, 20 bp, Artificial Sequence
  sgRNA
  Psg28_20
agagagacagtatacagaaa

SEQ ID NO: 50022 - DNA, 20 bp, Artificial Sequence
  sgRNA
  Psg29_1
gaggggaatgattcaatacg

SEQ ID NO: 50023 - DNA, 20 bp, Artificial Sequence
  sgRNA
  Psg29_2
ttggccgatacacaataggc

SEQ ID NO: 50024 - DNA, 20 bp, Artificial Sequence
  sgRNA
  Psg29_3
tccccttcagcaacatatcg

SEQ ID NO: 50025 - DNA, 20 bp, Artificial Sequence
  sgRNA
  Psg29_4
tgaattattgccatcccaag

SEQ ID NO: 50026 - DNA, 20 bp, Artificial Sequence
  sgRNA
  Psg29_5
tggatagtaatggatccctg

SEQ ID NO: 50027 - DNA, 20 bp, Artificial Sequence
  sgRNA
  Psg29_6
gagattggccgatacacaat

SEQ ID NO: 50028 - DNA, 20 bp, Artificial Sequence
  sgRNA
  Psg29_7
ggttacagcactgaaaagcg

SEQ ID NO: 50029 - DNA, 20 bp, Artificial Sequence
  sgRNA
  Psg29_8
tcccctccatcgttactgaa

SEQ ID NO: 50030 - DNA, 20 bp, Artificial Sequence
  sgRNA
  Psg29_9
tcggaggccacacttcgtag

SEQ ID NO: 50031 - DNA, 20 bp, Artificial Sequence
  sgRNA
  Psg29_10
tggaattgcactgtatgcag

SEQ ID NO: 50032 - DNA, 20 bp, Artificial Sequence
  sgRNA
  Psg29_11
gagtagaaccccctgccatg

SEQ ID NO: 50033 - DNA, 20 bp, Artificial Sequence
  sgRNA
  Psg29_12
aggccagtcaccctatcagg

SEQ ID NO: 50034 - DNA, 20 bp, Artificial Sequence
  sgRNA
  Psg29_13
gcaaaggctgtaagattccc

SEQ ID NO: 50035 - DNA, 20 bp, Artificial Sequence
  sgRNA
  Psg29_14
gatgctccaggacgtcactg

SEQ ID NO: 50036 - DNA, 20 bp, Artificial Sequence
  sgRNA
  Psg29_15
agagatacggtgtatgccaa

SEQ ID NO: 50037 - DNA, 20 bp, Artificial Sequence
  sgRNA
  Psg29_16
agagagacattgtacaacaa

SEQ ID NO: 50038 - DNA, 20 bp, Artificial Sequence
  sgRNA
  Psg29_17
tatctgtacccagtactcgt

SEQ ID NO: 50039 - DNA, 20 bp, Artificial Sequence
  sgRNA
  Psg29_18
gctattgaagaaccaaagga

SEQ ID NO: 50040 - DNA, 20 bp, Artificial Sequence
  sgRNA
  Psg29_19
ttatacaccctacgagtact

SEQ ID NO: 50041 - DNA, 20 bp, Artificial Sequence
  sgRNA
  Psg29_20
aggatattaactcttctggc

SEQ ID NO: 50042 - DNA, 20 bp, Artificial Sequence
  sgRNA
  Ptafr_1
attgtctactactacaacga

SEQ ID NO: 50043 - DNA, 20 bp, Artificial Sequence
  sgRNA
  Ptafr_2
catcaatacctactgcagtg

SEQ ID NO: 50044 - DNA, 20 bp, Artificial Sequence
  sgRNA
  Ptafr_3
agagatgccacgcttgcggg

SEQ ID NO: 50045 - DNA, 20 bp, Artificial Sequence
  sgRNA
  Ptafr_4
aagacatgaacaacaaggat

SEQ ID NO: 50046 - DNA, 20 bp, Artificial Sequence
  sgRNA
  Ptafr_5
cacgagtgacacgtgcaccg

SEQ ID NO: 50047 - DNA, 20 bp, Artificial Sequence
  sgRNA
  Ptafr_6
catcacttataaccgctacc

SEQ ID NO: 50048 - DNA, 20 bp, Artificial Sequence
  sgRNA
  Ptafr_7
gaggcagcagcgcaaagcgg

SEQ ID NO: 50049 - DNA, 20 bp, Artificial Sequence
  sgRNA
  Ptafr_8
ctaccagaccaacttccatc

SEQ ID NO: 50050 - DNA, 20 bp, Artificial Sequence
  sgRNA
  Ptafr_9
tgaggcagcagcgcaaagcg

SEQ ID NO: 50051 - DNA, 20 bp, Artificial Sequence
  sgRNA
  Ptafr_10
tgatgggataggctactgcc

SEQ ID NO: 50052 - DNA, 20 bp, Artificial Sequence
  sgRNA
  Ptafr_11
tttacagcatgcgcagtagc

SEQ ID NO: 50053 - DNA, 20 bp, Artificial Sequence
  sgRNA
  Ptafr_12
gataggctactgcctggtag

SEQ ID NO: 50054 - DNA, 20 bp, Artificial Sequence
  sgRNA
  Ptafr_13
gtaagaaagcaatagataac

SEQ ID NO: 50055 - DNA, 20 bp, Artificial Sequence
  sgRNA
  Ptafr_14
aagatgacactgtaaacaat

SEQ ID NO: 50056 - DNA, 20 bp, Artificial Sequence
  sgRNA
  Ptafr_15
aacctagtgcccaataagga

SEQ ID NO: 50057 - DNA, 20 bp, Artificial Sequence
  sgRNA
  Ptafr_16
gattgtctactactacaacg

SEQ ID NO: 50058 - DNA, 20 bp, Artificial Sequence
  sgRNA
  Ptafr_17
gccacgttgcacaggaagtt

SEQ ID NO: 50059 - DNA, 20 bp, Artificial Sequence
  sgRNA
  Ptafr_18
atactgggggtggttgccaa

SEQ ID NO: 50060 - DNA, 20 bp, Artificial Sequence
  sgRNA
  Ptafr_19
gttggctggcactatcacct

SEQ ID NO: 50061 - DNA, 20 bp, Artificial Sequence
  sgRNA
  Ptafr_20
catgaggcagcagcgcaaag

SEQ ID NO: 50062 - DNA, 20 bp, Artificial Sequence
  sgRNA
  Ptch1_1
agctaatctcgagaccaacg

SEQ ID NO: 50063 - DNA, 20 bp, Artificial Sequence
  sgRNA
  Ptch1_2
tgtgagggtcatactctgtg

SEQ ID NO: 50064 - DNA, 20 bp, Artificial Sequence
  sgRNA
  Ptch1_3
ctggcagaggacttacgtgg

SEQ ID NO: 50065 - DNA, 20 bp, Artificial Sequence
  sgRNA
  Ptch1_4
taaaaatggatcagatgacg

SEQ ID NO: 50066 - DNA, 20 bp, Artificial Sequence
  sgRNA
  Ptch1_5
gctgctgctatccatcagcg

SEQ ID NO: 50067 - DNA, 20 bp, Artificial Sequence
  sgRNA
  Ptch1_6
agtggagttcaccgtccacg

SEQ ID NO: 50068 - DNA, 20 bp, Artificial Sequence
  sgRNA
  Ptch1_7
tgtcatggacccactccggc

SEQ ID NO: 50069 - DNA, 20 bp, Artificial Sequence
  sgRNA
  Ptch1_8
tgatgtcagtgtcatccgag

SEQ ID NO: 50070 - DNA, 20 bp, Artificial Sequence
  sgRNA
  Ptch1_9
agagctgtactccgagtcgg

SEQ ID NO: 50071 - DNA, 20 bp, Artificial Sequence
  sgRNA
  Ptch1_10
cagagcctcacagtaacacc

SEQ ID NO: 50072 - DNA, 20 bp, Artificial Sequence
  sgRNA
  Ptch1_11
agggcagacaaagagacccg

SEQ ID NO: 50073 - DNA, 20 bp, Artificial Sequence
  sgRNA
  Ptch1_12
ctctgtgcggagctgaacgg

SEQ ID NO: 50074 - DNA, 20 bp, Artificial Sequence
  sgRNA
  Ptch1_13
aagtttgtccaccgtaaagg

SEQ ID NO: 50075 - DNA, 20 bp, Artificial Sequence
  sgRNA
  Ptch1_14
gcaaggccagcagcctcgaa

SEQ ID NO: 50076 - DNA, 20 bp, Artificial Sequence
  sgRNA
  Ptch1_15
actccgccgaaagcctgcgg

SEQ ID NO: 50077 - DNA, 20 bp, Artificial Sequence
  sgRNA
  Ptch1_16
taatctcgagaccaacgtgg

SEQ ID NO: 50078 - DNA, 20 bp, Artificial Sequence
  sgRNA
  Ptch1_17
tgggactgctccaagtccca

SEQ ID NO: 50079 - DNA, 20 bp, Artificial Sequence
  sgRNA
  Ptch1_18
ctacatctacctgaccgctt

SEQ ID NO: 50080 - DNA, 20 bp, Artificial Sequence
  sgRNA
  Ptch1_19
ataaagccgaagttggccat

SEQ ID NO: 50081 - DNA, 20 bp, Artificial Sequence
  sgRNA
  Ptch1_20
cggtggacgttgggttccga

SEQ ID NO: 50082 - DNA, 20 bp, Artificial Sequence
  sgRNA
  Ptchd1_1
aacccaagtaggcctaacca

SEQ ID NO: 50083 - DNA, 20 bp, Artificial Sequence
  sgRNA
  Ptchd1_2
tctgacggctagattcagtg

SEQ ID NO: 50084 - DNA, 20 bp, Artificial Sequence
  sgRNA
  Ptchd1_3
tataatgggcaccaactcgg

SEQ ID NO: 50085 - DNA, 20 bp, Artificial Sequence
  sgRNA
  Ptchd1_4
ttgaaatgttatcctcgtgg

SEQ ID NO: 50086 - DNA, 20 bp, Artificial Sequence
  sgRNA
  Ptchd1_5
ggatcgggtgaaatctgcag

SEQ ID NO: 50087 - DNA, 20 bp, Artificial Sequence
  sgRNA
  Ptchd1_6
gtaacgttctgatacacggc

SEQ ID NO: 50088 - DNA, 20 bp, Artificial Sequence
  sgRNA
  Ptchd1_7
catgctagaccaacatcaca

SEQ ID NO: 50089 - DNA, 20 bp, Artificial Sequence
  sgRNA
  Ptchd1_8
agatattgatagtactcgag

SEQ ID NO: 50090 - DNA, 20 bp, Artificial Sequence
  sgRNA
  Ptchd1_9
gaaaaatcctgaaaaccggg

SEQ ID NO: 50091 - DNA, 20 bp, Artificial Sequence
  sgRNA
  Ptchd1_10
ctaccaggtcgaagagagcg

SEQ ID NO: 50092 - DNA, 20 bp, Artificial Sequence
  sgRNA
  Ptchd1_11
gtacacatcctcatcactga

SEQ ID NO: 50093 - DNA, 20 bp, Artificial Sequence
  sgRNA
  Ptchd1_12
atagaccaacaatataacag

SEQ ID NO: 50094 - DNA, 20 bp, Artificial Sequence
  sgRNA
  Ptchd1_13
agaacaaatgtggataacag

SEQ ID NO: 50095 - DNA, 20 bp, Artificial Sequence
  sgRNA
  Ptchd1_14
cgctctcttcgacctggtag

SEQ ID NO: 50096 - DNA, 20 bp, Artificial Sequence
  sgRNA
  Ptchd1_15
agagcagcacagaatagcca

SEQ ID NO: 50097 - DNA, 20 bp, Artificial Sequence
  sgRNA
  Ptchd1_16
gccggaatcatcaatctcac

SEQ ID NO: 50098 - DNA, 20 bp, Artificial Sequence
  sgRNA
  Ptchd1_17
gctccacgctctcttcgacc

SEQ ID NO: 50099 - DNA, 20 bp, Artificial Sequence
  sgRNA
  Ptchd1_18
gttgattgattgcagatagt

SEQ ID NO: 50100 - DNA, 20 bp, Artificial Sequence
  sgRNA
  Ptchd1_19
gcatgacgaaagggactccc

SEQ ID NO: 50101 - DNA, 20 bp, Artificial Sequence
  sgRNA
  Ptchd1_20
ttatggtcaccaacccaagt

SEQ ID NO: 50102 - DNA, 20 bp, Artificial Sequence
  sgRNA
  Ptchd3_1
ggttcattgatagacaaaca

SEQ ID NO: 50103 - DNA, 20 bp, Artificial Sequence
  sgRNA
  Ptchd3_2
actgtactacctcaagacgg

SEQ ID NO: 50104 - DNA, 20 bp, Artificial Sequence
  sgRNA
  Ptchd3_3
aatgtatgccaagtgaaaca

SEQ ID NO: 50105 - DNA, 20 bp, Artificial Sequence
  sgRNA
  Ptchd3_4
cgttggaagccccgcgacag

SEQ ID NO: 50106 - DNA, 20 bp, Artificial Sequence
  sgRNA
  Ptchd3_5
actactgtactacctcaaga

SEQ ID NO: 50107 - DNA, 20 bp, Artificial Sequence
  sgRNA
  Ptchd3_6
ttggaagcaccgctgtcgcg

SEQ ID NO: 50108 - DNA, 20 bp, Artificial Sequence
  sgRNA
  Ptchd3_7
cagttggtgtggcagcgacg

SEQ ID NO: 50109 - DNA, 20 bp, Artificial Sequence
  sgRNA
  Ptchd3_8
gaggagcagtacacaccgat

SEQ ID NO: 50110 - DNA, 20 bp, Artificial Sequence
  sgRNA
  Ptchd3_9
ggcccgagcaaaaacagcca

SEQ ID NO: 50111 - DNA, 20 bp, Artificial Sequence
  sgRNA
  Ptchd3_10
gcttggttatataccattaa

SEQ ID NO: 50112 - DNA, 20 bp, Artificial Sequence
  sgRNA
  Ptchd3_11
caccccctacttcaatgtag

SEQ ID NO: 50113 - DNA, 20 bp, Artificial Sequence
  sgRNA
  Ptchd3_12
aacgcagattctataccaag

SEQ ID NO: 50114 - DNA, 20 bp, Artificial Sequence
  sgRNA
  Ptchd3_13
gttgccatgtcagtggtgag

SEQ ID NO: 50115 - DNA, 20 bp, Artificial Sequence
  sgRNA
  Ptchd3_14
gttctcttatgctctctgag

SEQ ID NO: 50116 - DNA, 20 bp, Artificial Sequence
  sgRNA
  Ptchd3_15
tgatcacaaatgggacccca

SEQ ID NO: 50117 - DNA, 20 bp, Artificial Sequence
  sgRNA
  Ptchd3_16
ggaggtgcctcctgacccag

SEQ ID NO: 50118 - DNA, 20 bp, Artificial Sequence
  sgRNA
  Ptchd3_17
tctccgagctccaccttgga

SEQ ID NO: 50119 - DNA, 20 bp, Artificial Sequence
  sgRNA
  Ptchd3_18
aatgaaatcacttcttcccg

SEQ ID NO: 50120 - DNA, 20 bp, Artificial Sequence
  sgRNA
  Ptchd3_19
ctccagcagtgagttggcga

SEQ ID NO: 50121 - DNA, 20 bp, Artificial Sequence
  sgRNA
  Ptchd3_20
ttgtctatcaatgaaccgaa

SEQ ID NO: 50122 - DNA, 20 bp, Artificial Sequence
  sgRNA
  Ptchd4_1
agacgtagaatcctattaca

SEQ ID NO: 50123 - DNA, 20 bp, Artificial Sequence
  sgRNA
  Ptchd4_2
attactgtctggaaccacac

SEQ ID NO: 50124 - DNA, 20 bp, Artificial Sequence
  sgRNA
  Ptchd4_3
ggtgaccatcacatcagagt

SEQ ID NO: 50125 - DNA, 20 bp, Artificial Sequence
  sgRNA
  Ptchd4_4
tggagcaaaatattgtcccc

SEQ ID NO: 50126 - DNA, 20 bp, Artificial Sequence
  sgRNA
  Ptchd4_5
aaatgcttgctgctgaccgg

SEQ ID NO: 50127 - DNA, 20 bp, Artificial Sequence
  sgRNA
  Ptchd4_6
gtaatggtctgtgaaaacaa

SEQ ID NO: 50128 - DNA, 20 bp, Artificial Sequence
  sgRNA
  Ptchd4_7
tctccaataagacaacagcc

SEQ ID NO: 50129 - DNA, 20 bp, Artificial Sequence
  sgRNA
  Ptchd4_8
ctccaataagacaacagcca

SEQ ID NO: 50130 - DNA, 20 bp, Artificial Sequence
  sgRNA
  Ptchd4_9
attcggacttacacacccct

SEQ ID NO: 50131 - DNA, 20 bp, Artificial Sequence
  sgRNA
  Ptchd4_10
gatcctcctctcctcacccg

SEQ ID NO: 50132 - DNA, 20 bp, Artificial Sequence
  sgRNA
  Ptchd4_11
ctcaaccgcttccagaccga

SEQ ID NO: 50133 - DNA, 20 bp, Artificial Sequence
  sgRNA
  Ptchd4_12
ggtccaggtattctgcagaa

SEQ ID NO: 50134 - DNA, 20 bp, Artificial Sequence
  sgRNA
  Ptchd4_13
tctgctaccctgtctttgaa

SEQ ID NO: 50135 - DNA, 20 bp, Artificial Sequence
  sgRNA
  Ptchd4_14
cctagtgctgatcctgacca

SEQ ID NO: 50136 - DNA, 20 bp, Artificial Sequence
  sgRNA
  Ptchd4_15
tttattggacaccagctggg

SEQ ID NO: 50137 - DNA, 20 bp, Artificial Sequence
  sgRNA
  Ptchd4_16
tcatttccatcacggctcgg

SEQ ID NO: 50138 - DNA, 20 bp, Artificial Sequence
  sgRNA
  Ptchd4_17
gccaaacagcaaagaccagc

SEQ ID NO: 50139 - DNA, 20 bp, Artificial Sequence
  sgRNA
  Ptchd4_18
gcttatgaggaagctccagg

SEQ ID NO: 50140 - DNA, 20 bp, Artificial Sequence
  sgRNA
  Ptchd4_19
tttccatcgccactgcagcc

SEQ ID NO: 50141 - DNA, 20 bp, Artificial Sequence
  sgRNA
  Ptchd4_20
cagccccttcacaaacatag

SEQ ID NO: 50142 - DNA, 20 bp, Artificial Sequence
  sgRNA
  Ptcra_1
tcacactgctggtagatgga

SEQ ID NO: 50143 - DNA, 20 bp, Artificial Sequence
  sgRNA
  Ptcra_2
ggtttgcctggtcctcgatg

SEQ ID NO: 50144 - DNA, 20 bp, Artificial Sequence
  sgRNA
  Ptcra_3
cggtgccagagagggcccat

SEQ ID NO: 50145 - DNA, 20 bp, Artificial Sequence
  sgRNA
  Ptcra_4
aggcctggtgtgacagacca

SEQ ID NO: 50146 - DNA, 20 bp, Artificial Sequence
  sgRNA
  Ptcra_5
aggctagtccaggtgccgtc

SEQ ID NO: 50147 - DNA, 20 bp, Artificial Sequence
  sgRNA
  Ptcra_6
tctaccagcagtgtgatggg

SEQ ID NO: 50148 - DNA, 20 bp, Artificial Sequence
  sgRNA
  Ptcra_7
ggcctggtgtgacagaccaa

SEQ ID NO: 50149 - DNA, 20 bp, Artificial Sequence
  sgRNA
  Ptcra_8
tgctttccggagcctctcgg

SEQ ID NO: 50150 - DNA, 20 bp, Artificial Sequence
  sgRNA
  Ptcra_9
ccatctaccagcagtgtgat

SEQ ID NO: 50151 - DNA, 20 bp, Artificial Sequence
  sgRNA
  Ptcra_10
acagggttgtcaaggccagg

SEQ ID NO: 50152 - DNA, 20 bp, Artificial Sequence
  sgRNA
  Ptcra_11
gtctggttctcagctggcaa

SEQ ID NO: 50153 - DNA, 20 bp, Artificial Sequence
  sgRNA
  Ptcra_12
tgccagctgagaaccagaca

SEQ ID NO: 50154 - DNA, 20 bp, Artificial Sequence
  sgRNA
  Ptcra_13
cagcagccatgtcctagcca

SEQ ID NO: 50155 - DNA, 20 bp, Artificial Sequence
  sgRNA
  Ptcra_14
cccataggtgaaggcgtcta

SEQ ID NO: 50156 - DNA, 20 bp, Artificial Sequence
  sgRNA
  Ptcra_15
ctatgggccctctctggcac

SEQ ID NO: 50157 - DNA, 20 bp, Artificial Sequence
  sgRNA
  Ptcra_16
gtggagccagagacggaaag

SEQ ID NO: 50158 - DNA, 20 bp, Artificial Sequence
  sgRNA
  Ptcra_17
ttgccagctgagaaccagac

SEQ ID NO: 50159 - DNA, 20 bp, Artificial Sequence
  sgRNA
  Ptcra_18
tggtctgtcacaccaggcct

SEQ ID NO: 50160 - DNA, 20 bp, Artificial Sequence
  sgRNA
  Ptcra_19
tggaaggcagcacatgctgg

SEQ ID NO: 50161 - DNA, 20 bp, Artificial Sequence
  sgRNA
  Ptcra_20
ggtctgtcacaccaggcctg

SEQ ID NO: 50162 - DNA, 20 bp, Artificial Sequence
  sgRNA
  Ptgdr_1
atgacatgcacaggcgccag

SEQ ID NO: 50163 - DNA, 20 bp, Artificial Sequence
  sgRNA
  Ptgdr_2
acttcccaaaaccagcaaag

SEQ ID NO: 50164 - DNA, 20 bp, Artificial Sequence
  sgRNA
  Ptgdr_3
aggcacgtcaccttgcgccg

SEQ ID NO: 50165 - DNA, 20 bp, Artificial Sequence
  sgRNA
  Ptgdr_4
tttcatccagatgatccaca

SEQ ID NO: 50166 - DNA, 20 bp, Artificial Sequence
  sgRNA
  Ptgdr_5
acgagcacataaaagaccga

SEQ ID NO: 50167 - DNA, 20 bp, Artificial Sequence
  sgRNA
  Ptgdr_6
gctgctggtcctcgcaaccg

SEQ ID NO: 50168 - DNA, 20 bp, Artificial Sequence
  sgRNA
  Ptgdr_7
ggttgcacaccacggttgcg

SEQ ID NO: 50169 - DNA, 20 bp, Artificial Sequence
  sgRNA
  Ptgdr_8
ctatcctcaccgctgctcca

SEQ ID NO: 50170 - DNA, 20 bp, Artificial Sequence
  sgRNA
  Ptgdr_9
caagtgtctgatcagcccga

SEQ ID NO: 50171 - DNA, 20 bp, Artificial Sequence
  sgRNA
  Ptgdr_10
ggtggatgtctgacagcgat

SEQ ID NO: 50172 - DNA, 20 bp, Artificial Sequence
  sgRNA
  Ptgdr_11
gcgctgtgctcttcggtgcg

SEQ ID NO: 50173 - DNA, 20 bp, Artificial Sequence
  sgRNA
  Ptgdr_12
acataaaagaccgagggcgg

SEQ ID NO: 50174 - DNA, 20 bp, Artificial Sequence
  sgRNA
  Ptgdr_13
cgaggaccagcagcgccatg

SEQ ID NO: 50175 - DNA, 20 bp, Artificial Sequence
  sgRNA
  Ptgdr_14
agtctgagcctgactgggcg

SEQ ID NO: 50176 - DNA, 20 bp, Artificial Sequence
  sgRNA
  Ptgdr_15
cacagcgcccatcgtcgccg

SEQ ID NO: 50177 - DNA, 20 bp, Artificial Sequence
  sgRNA
  Ptgdr_16
cacgagcacataaaagaccg

SEQ ID NO: 50178 - DNA, 20 bp, Artificial Sequence
  sgRNA
  Ptgdr_17
ggcacccaggttgcacacca

SEQ ID NO: 50179 - DNA, 20 bp, Artificial Sequence
  sgRNA
  Ptgdr_18
tcgctgtcagacatccacct

SEQ ID NO: 50180 - DNA, 20 bp, Artificial Sequence
  sgRNA
  Ptgdr_19
atcgctgtcagacatccacc

SEQ ID NO: 50181 - DNA, 20 bp, Artificial Sequence
  sgRNA
  Ptgdr_20
acagctgttggctatggcgg

SEQ ID NO: 50182 - DNA, 20 bp, Artificial Sequence
  sgRNA
  Ptgdr2_1
acacgtggtcgatgtagcgg

SEQ ID NO: 50183 - DNA, 20 bp, Artificial Sequence
  sgRNA
  Ptgdr2_2
ggcacagaaccaccgcacgg

SEQ ID NO: 50184 - DNA, 20 bp, Artificial Sequence
  sgRNA
  Ptgdr2_3
gtcgcaggctcacggctacg

SEQ ID NO: 50185 - DNA, 20 bp, Artificial Sequence
  sgRNA
  Ptgdr2_4
cttctggcggtagtcgcacg

SEQ ID NO: 50186 - DNA, 20 bp, Artificial Sequence
  sgRNA
  Ptgdr2_5
gtgggcacagaaccaccgca

SEQ ID NO: 50187 - DNA, 20 bp, Artificial Sequence
  sgRNA
  Ptgdr2_6
ctaacaagtcggatagcgcc

SEQ ID NO: 50188 - DNA, 20 bp, Artificial Sequence
  sgRNA
  Ptgdr2_7
cgtgcaacagcaccgacacg

SEQ ID NO: 50189 - DNA, 20 bp, Artificial Sequence
  sgRNA
  Ptgdr2_8
ctaccgccagaaggccctgg

SEQ ID NO: 50190 - DNA, 20 bp, Artificial Sequence
  sgRNA
  Ptgdr2_9
ccgacatgttgtacaaactg

SEQ ID NO: 50191 - DNA, 20 bp, Artificial Sequence
  sgRNA
  Ptgdr2_10
ttgatcggctggatgaggcg

SEQ ID NO: 50192 - DNA, 20 bp, Artificial Sequence
  sgRNA
  Ptgdr2_11
tgttcagagacaccatcccg

SEQ ID NO: 50193 - DNA, 20 bp, Artificial Sequence
  sgRNA
  Ptgdr2_12
tacggcagctcgcgtcacgt

SEQ ID NO: 50194 - DNA, 20 bp, Artificial Sequence
  sgRNA
  Ptgdr2_13
atgatgcggccatcaagccg

SEQ ID NO: 50195 - DNA, 20 bp, Artificial Sequence
  sgRNA
  Ptgdr2_14
cctcatccagccgatcaagc

SEQ ID NO: 50196 - DNA, 20 bp, Artificial Sequence
  sgRNA
  Ptgdr2_15
acagaaccaccgcacggtgg

SEQ ID NO: 50197 - DNA, 20 bp, Artificial Sequence
  sgRNA
  Ptgdr2_16
gcagtttgtacaacatgtcg

SEQ ID NO: 50198 - DNA, 20 bp, Artificial Sequence
  sgRNA
  Ptgdr2_17
catgttgaggaagaagaccg

SEQ ID NO: 50199 - DNA, 20 bp, Artificial Sequence
  sgRNA
  Ptgdr2_18
cgaggaatgtagcttgcaga

SEQ ID NO: 50200 - DNA, 20 bp, Artificial Sequence
  sgRNA
  Ptgdr2_19
gcctcatccagccgatcaag

SEQ ID NO: 50201 - DNA, 20 bp, Artificial Sequence
  sgRNA
  Ptgdr2_20
agcctgcgactgcaccaccg

SEQ ID NO: 50202 - DNA, 20 bp, Artificial Sequence
  sgRNA
  Ptger1_1
tgcttcgcctgtatactgcg

SEQ ID NO: 50203 - DNA, 20 bp, Artificial Sequence
  sgRNA
  Ptger1_2
cgctacgagttacagtaccc

SEQ ID NO: 50204 - DNA, 20 bp, Artificial Sequence
  sgRNA
  Ptger1_3
ttagtgtgcaatacgctcag

SEQ ID NO: 50205 - DNA, 20 bp, Artificial Sequence
  sgRNA
  Ptger1_4
gcagcaccacagatgtattg

SEQ ID NO: 50206 - DNA, 20 bp, Artificial Sequence
  sgRNA
  Ptger1_5
ccacagatacgcgcgccgcg

SEQ ID NO: 50207 - DNA, 20 bp, Artificial Sequence
  sgRNA
  Ptger1_6
cacgcagccactgatccacg

SEQ ID NO: 50208 - DNA, 20 bp, Artificial Sequence
  sgRNA
  Ptger1_7
gcctggcgccaacctccacg

SEQ ID NO: 50209 - DNA, 20 bp, Artificial Sequence
  sgRNA
  Ptger1_8
ggatctggttccacgatgcg

SEQ ID NO: 50210 - DNA, 20 bp, Artificial Sequence
  sgRNA
  Ptger1_9
tattgcacactaatgccgca

SEQ ID NO: 50211 - DNA, 20 bp, Artificial Sequence
  sgRNA
  Ptger1_10
cgacgattccgaaagaccgc

SEQ ID NO: 50212 - DNA, 20 bp, Artificial Sequence
  sgRNA
  Ptger1_11
gtgtgcgtgaaccctgcgcg

SEQ ID NO: 50213 - DNA, 20 bp, Artificial Sequence
  sgRNA
  Ptger1_12
ccgcaggtcccgatgatcgc

SEQ ID NO: 50214 - DNA, 20 bp, Artificial Sequence
  sgRNA
  Ptger1_13
acgttgctgcctcatccgct

SEQ ID NO: 50215 - DNA, 20 bp, Artificial Sequence
  sgRNA
  Ptger1_14
gatgtgccattatcgcctgt

SEQ ID NO: 50216 - DNA, 20 bp, Artificial Sequence
  sgRNA
  Ptger1_15
cactaatgccgcaaggagcg

SEQ ID NO: 50217 - DNA, 20 bp, Artificial Sequence
  sgRNA
  Ptger1_16
ctgctgccactggtacacgt

SEQ ID NO: 50218 - DNA, 20 bp, Artificial Sequence
  sgRNA
  Ptger1_17
ggaactctaactccctgcag

SEQ ID NO: 50219 - DNA, 20 bp, Artificial Sequence
  sgRNA
  Ptger1_18
ctgcgtagttcccggcacag

SEQ ID NO: 50220 - DNA, 20 bp, Artificial Sequence
  sgRNA
  Ptger1_19
cgggcttaacctgagcctag

SEQ ID NO: 50221 - DNA, 20 bp, Artificial Sequence
  sgRNA
  Ptger1_20
agtatacaggcgaagcacca

SEQ ID NO: 50222 - DNA, 20 bp, Artificial Sequence
  sgRNA
  Ptger2_1
tactgccagacaatccgcag

SEQ ID NO: 50223 - DNA, 20 bp, Artificial Sequence
  sgRNA
  Ptger2_2
cctgccgctgctcaactacg

SEQ ID NO: 50224 - DNA, 20 bp, Artificial Sequence
  sgRNA
  Ptger2_3
cgccacttatcgcgccgcgg

SEQ ID NO: 50225 - DNA, 20 bp, Artificial Sequence
  sgRNA
  Ptger2_4
atattcaagaaaccagaccc

SEQ ID NO: 50226 - DNA, 20 bp, Artificial Sequence
  sgRNA
  Ptger2_5
gtagaagtaagggtacccga

SEQ ID NO: 50227 - DNA, 20 bp, Artificial Sequence
  sgRNA
  Ptger2_6
aggcgccacttatcgcgccg

SEQ ID NO: 50228 - DNA, 20 bp, Artificial Sequence
  sgRNA
  Ptger2_7
ataaaaaccgaagagctcgg

SEQ ID NO: 50229 - DNA, 20 bp, Artificial Sequence
  sgRNA
  Ptger2_8
gatggagaggtagcgttcca

SEQ ID NO: 50230 - DNA, 20 bp, Artificial Sequence
  sgRNA
  Ptger2_9
ggtgctttatccggcacggg

SEQ ID NO: 50231 - DNA, 20 bp, Artificial Sequence
  sgRNA
  Ptger2_10
ctcctctcctgcgagatcca

SEQ ID NO: 50232 - DNA, 20 bp, Artificial Sequence
  sgRNA
  Ptger2_11
tcagtgaagtccgacaacag

SEQ ID NO: 50233 - DNA, 20 bp, Artificial Sequence
  sgRNA
  Ptger2_12
cttgcagtcctccattagct

SEQ ID NO: 50234 - DNA, 20 bp, Artificial Sequence
  sgRNA
  Ptger2_13
tactccccgtagttgagcag

SEQ ID NO: 50235 - DNA, 20 bp, Artificial Sequence
  sgRNA
  Ptger2_14
agagaggacttcgatggcag

SEQ ID NO: 50236 - DNA, 20 bp, Artificial Sequence
  sgRNA
  Ptger2_15
cgcgtgactttcgggagcca

SEQ ID NO: 50237 - DNA, 20 bp, Artificial Sequence
  sgRNA
  Ptger2_16
gatgagattccccagaaccc

SEQ ID NO: 50238 - DNA, 20 bp, Artificial Sequence
  sgRNA
  Ptger2_17
agtggcgcctgtagaagtaa

SEQ ID NO: 50239 - DNA, 20 bp, Artificial Sequence
  sgRNA
  Ptger2_18
catcgtggccagactaaaga

SEQ ID NO: 50240 - DNA, 20 bp, Artificial Sequence
  sgRNA
  Ptger2_19
aacctgcctcatcagcccgg

SEQ ID NO: 50241 - DNA, 20 bp, Artificial Sequence
  sgRNA
  Ptger2_20
ctcggtgatgttctcggccg

SEQ ID NO: 50242 - DNA, 20 bp, Artificial Sequence
  sgRNA
  Ptger3_1
tcaagtactaccgacgactg

SEQ ID NO: 50243 - DNA, 20 bp, Artificial Sequence
  sgRNA
  Ptger3_2
atgtggctggcataccagtg

SEQ ID NO: 50244 - DNA, 20 bp, Artificial Sequence
  sgRNA
  Ptger3_3
gggagcagctcgacccatcg

SEQ ID NO: 50245 - DNA, 20 bp, Artificial Sequence
  sgRNA
  Ptger3_4
tggcgctcaccgacttagtg

SEQ ID NO: 50246 - DNA, 20 bp, Artificial Sequence
  sgRNA
  Ptger3_5
gtcgctgtgacaggtacacg

SEQ ID NO: 50247 - DNA, 20 bp, Artificial Sequence
  sgRNA
  Ptger3_6
gggtctgtctcgttgcccgc

SEQ ID NO: 50248 - DNA, 20 bp, Artificial Sequence
  sgRNA
  Ptger3_7
aggtgcacagacgccccgat

SEQ ID NO: 50249 - DNA, 20 bp, Artificial Sequence
  sgRNA
  Ptger3_8
gcgtggcgcgagtcttcatg

SEQ ID NO: 50250 - DNA, 20 bp, Artificial Sequence
  sgRNA
  Ptger3_9
gtacctgtcacagcgacgct

SEQ ID NO: 50251 - DNA, 20 bp, Artificial Sequence
  sgRNA
  Ptger3_10
gagctggatggccgtctccg

SEQ ID NO: 50252 - DNA, 20 bp, Artificial Sequence
  sgRNA
  Ptger3_11
gagacggccatccagctcat

SEQ ID NO: 50253 - DNA, 20 bp, Artificial Sequence
  sgRNA
  Ptger3_12
ggacacggagccgcagtcgt

SEQ ID NO: 50254 - DNA, 20 bp, Artificial Sequence
  sgRNA
  Ptger3_13
gctgcgcgacacgagcagca

SEQ ID NO: 50255 - DNA, 20 bp, Artificial Sequence
  sgRNA
  Ptger3_14
ataccagtgcggcgcacgga

SEQ ID NO: 50256 - DNA, 20 bp, Artificial Sequence
  sgRNA
  Ptger3_15
tcttagcagcagataaaccc

SEQ ID NO: 50257 - DNA, 20 bp, Artificial Sequence
  sgRNA
  Ptger3_16
gctggcgctcaccgacttag

SEQ ID NO: 50258 - DNA, 20 bp, Artificial Sequence
  sgRNA
  Ptger3_17
tggcataccagtgcggcgca

SEQ ID NO: 50259 - DNA, 20 bp, Artificial Sequence
  sgRNA
  Ptger3_18
catgatccccatgagctgga

SEQ ID NO: 50260 - DNA, 20 bp, Artificial Sequence
  sgRNA
  Ptger3_19
ggatagcccgaacactgtca

SEQ ID NO: 50261 - DNA, 20 bp, Artificial Sequence
  sgRNA
  Ptger3_20
tctgagaatttcttctccca

SEQ ID NO: 50262 - DNA, 20 bp, Artificial Sequence
  sgRNA
  Ptger4_1
ccagttatatcagccaaacg

SEQ ID NO: 50263 - DNA, 20 bp, Artificial Sequence
  sgRNA
  Ptger4_2
ggccaccgaagctaccgcgg

SEQ ID NO: 50264 - DNA, 20 bp, Artificial Sequence
  sgRNA
  Ptger4_3
cgacttgcacaatactacga

SEQ ID NO: 50265 - DNA, 20 bp, Artificial Sequence
  sgRNA
  Ptger4_4
acagccactacgtggacaag

SEQ ID NO: 50266 - DNA, 20 bp, Artificial Sequence
  sgRNA
  Ptger4_5
ctacttctacagccactacg

SEQ ID NO: 50267 - DNA, 20 bp, Artificial Sequence
  sgRNA
  Ptger4_6
gctccgtgcccaacgaggtg

SEQ ID NO: 50268 - DNA, 20 bp, Artificial Sequence
  sgRNA
  Ptger4_7
gtgctgctccgtgcccaacg

SEQ ID NO: 50269 - DNA, 20 bp, Artificial Sequence
  sgRNA
  Ptger4_8
ggtccagtcgatgaagcacc

SEQ ID NO: 50270 - DNA, 20 bp, Artificial Sequence
  sgRNA
  Ptger4_9
aaagtcgctgaggcgctgca

SEQ ID NO: 50271 - DNA, 20 bp, Artificial Sequence
  sgRNA
  Ptger4_10
tggttagtaacacacagcgt

SEQ ID NO: 50272 - DNA, 20 bp, Artificial Sequence
  sgRNA
  Ptger4_11
agtattgtgcaagtcgcgca

SEQ ID NO: 50273 - DNA, 20 bp, Artificial Sequence
  sgRNA
  Ptger4_12
cgcgggtgcggagatccaga

SEQ ID NO: 50274 - DNA, 20 bp, Artificial Sequence
  sgRNA
  Ptger4_13
gggcacggagcagcaccatg

SEQ ID NO: 50275 - DNA, 20 bp, Artificial Sequence
  sgRNA
  Ptger4_14
acaatactacgatggccacc

SEQ ID NO: 50276 - DNA, 20 bp, Artificial Sequence
  sgRNA
  Ptger4_15
tgcgccggaaactcctgcgg

SEQ ID NO: 50277 - DNA, 20 bp, Artificial Sequence
  sgRNA
  Ptger4_16
gagacctcagactcctccca

SEQ ID NO: 50278 - DNA, 20 bp, Artificial Sequence
  sgRNA
  Ptger4_17
gcatgaactggcggtgcatg

SEQ ID NO: 50279 - DNA, 20 bp, Artificial Sequence
  sgRNA
  Ptger4_18
gatgagcaccaccagagagg

SEQ ID NO: 50280 - DNA, 20 bp, Artificial Sequence
  sgRNA
  Ptger4_19
agaaggacgcgttgactccg

SEQ ID NO: 50281 - DNA, 20 bp, Artificial Sequence
  sgRNA
  Ptger4_20
ggcgtacatgtaagagaagg

SEQ ID NO: 50282 - DNA, 20 bp, Artificial Sequence
  sgRNA
  Ptgfr_1
tttggccaccttatcaacgg

SEQ ID NO: 50283 - DNA, 20 bp, Artificial Sequence
  sgRNA
  Ptgfr_2
gcagtgcgatggccatcgag

SEQ ID NO: 50284 - DNA, 20 bp, Artificial Sequence
  sgRNA
  Ptgfr_3
cttctgtctaaatctctggt

SEQ ID NO: 50285 - DNA, 20 bp, Artificial Sequence
  sgRNA
  Ptgfr_4
agattccaaaaatactgcac

SEQ ID NO: 50286 - DNA, 20 bp, Artificial Sequence
  sgRNA
  Ptgfr_5
ggtctatattctgctacgga

SEQ ID NO: 50287 - DNA, 20 bp, Artificial Sequence
  sgRNA
  Ptgfr_6
caccaagagctaagagtccg

SEQ ID NO: 50288 - DNA, 20 bp, Artificial Sequence
  sgRNA
  Ptgfr_7
gttaactccacagcaacgac

SEQ ID NO: 50289 - DNA, 20 bp, Artificial Sequence
  sgRNA
  Ptgfr_8
gactcctatacacctctcga

SEQ ID NO: 50290 - DNA, 20 bp, Artificial Sequence
  sgRNA
  Ptgfr_9
gctgaatgatcatctccagg

SEQ ID NO: 50291 - DNA, 20 bp, Artificial Sequence
  sgRNA
  Ptgfr_10
cgtagagtgaaatataggat

SEQ ID NO: 50292 - DNA, 20 bp, Artificial Sequence
  sgRNA
  Ptgfr_11
ggatgtttgactgatcaaag

SEQ ID NO: 50293 - DNA, 20 bp, Artificial Sequence
  sgRNA
  Ptgfr_12
acacagagcacatcgaagac

SEQ ID NO: 50294 - DNA, 20 bp, Artificial Sequence
  sgRNA
  Ptgfr_13
tcgcactgcctagaaaaagt

SEQ ID NO: 50295 - DNA, 20 bp, Artificial Sequence
  sgRNA
  Ptgfr_14
ctatgcctccgttgataagg

SEQ ID NO: 50296 - DNA, 20 bp, Artificial Sequence
  sgRNA
  Ptgfr_15
tgtcgtttcacaggtcactg

SEQ ID NO: 50297 - DNA, 20 bp, Artificial Sequence
  sgRNA
  Ptgfr_16
tctatcatcttcatgacagt

SEQ ID NO: 50298 - DNA, 20 bp, Artificial Sequence
  sgRNA
  Ptgfr_17
tcatgagaatggcgatggcc

SEQ ID NO: 50299 - DNA, 20 bp, Artificial Sequence
  sgRNA
  Ptgfr_18
tctgattccacgttgccatg

SEQ ID NO: 50300 - DNA, 20 bp, Artificial Sequence
  sgRNA
  Ptgfr_19
ttctttggccaccttatcaa

SEQ ID NO: 50301 - DNA, 20 bp, Artificial Sequence
  sgRNA
  Ptgfr_20
ctgaaagccggttctccgtc

SEQ ID NO: 50302 - DNA, 20 bp, Artificial Sequence
  sgRNA
  Ptgfrn_1
ggtcacgcttacaccagacg

SEQ ID NO: 50303 - DNA, 20 bp, Artificial Sequence
  sgRNA
  Ptgfrn_2
cattctatagtaccacgaca

SEQ ID NO: 50304 - DNA, 20 bp, Artificial Sequence
  sgRNA
  Ptgfrn_3
atcctagccctaagccacga

SEQ ID NO: 50305 - DNA, 20 bp, Artificial Sequence
  sgRNA
  Ptgfrn_4
agcggggtgatatcctgttg

SEQ ID NO: 50306 - DNA, 20 bp, Artificial Sequence
  sgRNA
  Ptgfrn_5
gcgtgtggtgagagtccctg

SEQ ID NO: 50307 - DNA, 20 bp, Artificial Sequence
  sgRNA
  Ptgfrn_6
agtgcccaccacgcgaacca

SEQ ID NO: 50308 - DNA, 20 bp, Artificial Sequence
  sgRNA
  Ptgfrn_7
tcatagtcgctgacattgca

SEQ ID NO: 50309 - DNA, 20 bp, Artificial Sequence
  sgRNA
  Ptgfrn_8
aggaggttcgggagacgcgt

SEQ ID NO: 50310 - DNA, 20 bp, Artificial Sequence
  sgRNA
  Ptgfrn_9
gacacaccatccgtcacccg

SEQ ID NO: 50311 - DNA, 20 bp, Artificial Sequence
  sgRNA
  Ptgfrn_10
catcctagccctaagccacg

SEQ ID NO: 50312 - DNA, 20 bp, Artificial Sequence
  sgRNA
  Ptgfrn_11
agtaccacgacacggtaagt

SEQ ID NO: 50313 - DNA, 20 bp, Artificial Sequence
  sgRNA
  Ptgfrn_12
cactgtccagggcaactacg

SEQ ID NO: 50314 - DNA, 20 bp, Artificial Sequence
  sgRNA
  Ptgfrn_13
acaatttgatgagatctccc

SEQ ID NO: 50315 - DNA, 20 bp, Artificial Sequence
  sgRNA
  Ptgfrn_14
tggggtcgtctgaaaacccg

SEQ ID NO: 50316 - DNA, 20 bp, Artificial Sequence
  sgRNA
  Ptgfrn_15
atcacggctgagaagcccgt

SEQ ID NO: 50317 - DNA, 20 bp, Artificial Sequence
  sgRNA
  Ptgfrn_16
ccaccacgtcgtcattgcga

SEQ ID NO: 50318 - DNA, 20 bp, Artificial Sequence
  sgRNA
  Ptgfrn_17
ggtagcgctgctcatagcca

SEQ ID NO: 50319 - DNA, 20 bp, Artificial Sequence
  sgRNA
  Ptgfrn_18
gacgcttcgtgtctatcacc

SEQ ID NO: 50320 - DNA, 20 bp, Artificial Sequence
  sgRNA
  Ptgfrn_19
agatctccccgggtgacgga

SEQ ID NO: 50321 - DNA, 20 bp, Artificial Sequence
  sgRNA
  Ptgfrn_20
gcagcggtacaggcccgcat

SEQ ID NO: 50322 - DNA, 20 bp, Artificial Sequence
  sgRNA
  Ptgir_1
acctacgttcaagactcggt

SEQ ID NO: 50323 - DNA, 20 bp, Artificial Sequence
  sgRNA
  Ptgir_2
tcggtacaaacgagccatgg

SEQ ID NO: 50324 - DNA, 20 bp, Artificial Sequence
  sgRNA
  Ptgir_3
catggcaaagaggatgagcg

SEQ ID NO: 50325 - DNA, 20 bp, Artificial Sequence
  sgRNA
  Ptgir_4
cataggccacaaacactgca

SEQ ID NO: 50326 - DNA, 20 bp, Artificial Sequence
  sgRNA
  Ptgir_5
ccaacaccgcaaaggccgat

SEQ ID NO: 50327 - DNA, 20 bp, Artificial Sequence
  sgRNA
  Ptgir_6
aggtcggtacaaacgagcca

SEQ ID NO: 50328 - DNA, 20 bp, Artificial Sequence
  sgRNA
  Ptgir_7
aacgtaggtgatattccagc

SEQ ID NO: 50329 - DNA, 20 bp, Artificial Sequence
  sgRNA
  Ptgir_8
aatactgctgatgctcgccc

SEQ ID NO: 50330 - DNA, 20 bp, Artificial Sequence
  sgRNA
  Ptgir_9
ggagagaagtaggagccggt

SEQ ID NO: 50331 - DNA, 20 bp, Artificial Sequence
  sgRNA
  Ptgir_10
ccgacggaggtcacacccat

SEQ ID NO: 50332 - DNA, 20 bp, Artificial Sequence
  sgRNA
  Ptgir_11
cgatggcctgagtgaagcct

SEQ ID NO: 50333 - DNA, 20 bp, Artificial Sequence
  sgRNA
  Ptgir_12
ttcatcctctcgtgcccgag

SEQ ID NO: 50334 - DNA, 20 bp, Artificial Sequence
  sgRNA
  Ptgir_13
ggaaaaggatgaagacccag

SEQ ID NO: 50335 - DNA, 20 bp, Artificial Sequence
  sgRNA
  Ptgir_14
tgagggccagcagaatcagg

SEQ ID NO: 50336 - DNA, 20 bp, Artificial Sequence
  sgRNA
  Ptgir_15
agcatcagcagtattgccca

SEQ ID NO: 50337 - DNA, 20 bp, Artificial Sequence
  sgRNA
  Ptgir_16
tgggcatcctgggtgcccga

SEQ ID NO: 50338 - DNA, 20 bp, Artificial Sequence
  sgRNA
  Ptgir_17
ccctttccagacctgcatcg

SEQ ID NO: 50339 - DNA, 20 bp, Artificial Sequence
  sgRNA
  Ptgir_18
gctccacagccatggcaaag

SEQ ID NO: 50340 - DNA, 20 bp, Artificial Sequence
  sgRNA
  Ptgir_19
ggagcacacggccatgatga

SEQ ID NO: 50341 - DNA, 20 bp, Artificial Sequence
  sgRNA
  Ptgir_20
aaggcaaagcgggcgcagcg

SEQ ID NO: 50342 - DNA, 20 bp, Artificial Sequence
  sgRNA
  Pth1r_1
tccagggcacaaccggacgt

SEQ ID NO: 50343 - DNA, 20 bp, Artificial Sequence
  sgRNA
  Pth1r_2
tcataaatgtaatcgggaca

SEQ ID NO: 50344 - DNA, 20 bp, Artificial Sequence
  sgRNA
  Pth1r_3
ccgcccacctaaaataggct

SEQ ID NO: 50345 - DNA, 20 bp, Artificial Sequence
  sgRNA
  Pth1r_4
gagcaaccttggccaacact

SEQ ID NO: 50346 - DNA, 20 bp, Artificial Sequence
  sgRNA
  Pth1r_5
agagttgcatatcatcgcgc

SEQ ID NO: 50347 - DNA, 20 bp, Artificial Sequence
  sgRNA
  Pth1r_6
catggccttgccgtacaccg

SEQ ID NO: 50348 - DNA, 20 bp, Artificial Sequence
  sgRNA
  Pth1r_7
tgaggccgagcgcctcacgg

SEQ ID NO: 50349 - DNA, 20 bp, Artificial Sequence
  sgRNA
  Pth1r_8
cctgggcatgatctacaccg

SEQ ID NO: 50350 - DNA, 20 bp, Artificial Sequence
  sgRNA
  Pth1r_9
agtccaatgccagtgtccag

SEQ ID NO: 50351 - DNA, 20 bp, Artificial Sequence
  sgRNA
  Pth1r_10
gtccttcacgaagatgctcg

SEQ ID NO: 50352 - DNA, 20 bp, Artificial Sequence
  sgRNA
  Pth1r_11
atgacagttcccaaggacga

SEQ ID NO: 50353 - DNA, 20 bp, Artificial Sequence
  sgRNA
  Pth1r_12
gctcagctccgcatatgcgc

SEQ ID NO: 50354 - DNA, 20 bp, Artificial Sequence
  sgRNA
  Pth1r_13
attggtctcccgaagcttag

SEQ ID NO: 50355 - DNA, 20 bp, Artificial Sequence
  sgRNA
  Pth1r_14
tatgcaactcttcctccgtg

SEQ ID NO: 50356 - DNA, 20 bp, Artificial Sequence
  sgRNA
  Pth1r_15
gtacggcaaggccatgaaga

SEQ ID NO: 50357 - DNA, 20 bp, Artificial Sequence
  sgRNA
  Pth1r_16
aagagacatggaatatccca

SEQ ID NO: 50358 - DNA, 20 bp, Artificial Sequence
  sgRNA
  Pth1r_17
tcaagcgtaaagcacgaagt

SEQ ID NO: 50359 - DNA, 20 bp, Artificial Sequence
  sgRNA
  Pth1r_18
gctctactctggcttcacgc

SEQ ID NO: 50360 - DNA, 20 bp, Artificial Sequence
  sgRNA
  Pth1r_19
cagcttgtcacattgcgcct

SEQ ID NO: 50361 - DNA, 20 bp, Artificial Sequence
  sgRNA
  Pth1r_20
ggctaggatgagcacagcca

SEQ ID NO: 50362 - DNA, 20 bp, Artificial Sequence
  sgRNA
  Pth2r_1
ataggcgattgcattgcacg

SEQ ID NO: 50363 - DNA, 20 bp, Artificial Sequence
  sgRNA
  Pth2r_2
ttgaagtcgtaaacatacgg

SEQ ID NO: 50364 - DNA, 20 bp, Artificial Sequence
  sgRNA
  Pth2r_3
tggttcattcataacaggtg

SEQ ID NO: 50365 - DNA, 20 bp, Artificial Sequence
  sgRNA
  Pth2r_4
tccgatcttagctgctattg

SEQ ID NO: 50366 - DNA, 20 bp, Artificial Sequence
  sgRNA
  Pth2r_5
ccaaacacactcgccccccg

SEQ ID NO: 50367 - DNA, 20 bp, Artificial Sequence
  sgRNA
  Pth2r_6
aatagaatcccacgtcccat

SEQ ID NO: 50368 - DNA, 20 bp, Artificial Sequence
  sgRNA
  Pth2r_7
catgtcatgcccaaccgcat

SEQ ID NO: 50369 - DNA, 20 bp, Artificial Sequence
  sgRNA
  Pth2r_8
ccttccttagtctcctcggg

SEQ ID NO: 50370 - DNA, 20 bp, Artificial Sequence
  sgRNA
  Pth2r_9
gatggaatctgtccatcgac

SEQ ID NO: 50371 - DNA, 20 bp, Artificial Sequence
  sgRNA
  Pth2r_10
ctgcagcctgatatcaacat

SEQ ID NO: 50372 - DNA, 20 bp, Artificial Sequence
  sgRNA
  Pth2r_11
tgaagtcgtaaacatacgga

SEQ ID NO: 50373 - DNA, 20 bp, Artificial Sequence
  sgRNA
  Pth2r_12
ccttgtggcggccaaaggta

SEQ ID NO: 50374 - DNA, 20 bp, Artificial Sequence
  sgRNA
  Pth2r_13
gcagtctgaatagttagccc

SEQ ID NO: 50375 - DNA, 20 bp, Artificial Sequence
  sgRNA
  Pth2r_14
atagaatcccacgtcccatt

SEQ ID NO: 50376 - DNA, 20 bp, Artificial Sequence
  sgRNA
  Pth2r_15
ggcttcatctcgataggctg

SEQ ID NO: 50377 - DNA, 20 bp, Artificial Sequence
  sgRNA
  Pth2r_16
tcatggctcaaataaaacct

SEQ ID NO: 50378 - DNA, 20 bp, Artificial Sequence
  sgRNA
  Pth2r_17
tttccgacaccaaatacctg

SEQ ID NO: 50379 - DNA, 20 bp, Artificial Sequence
  sgRNA
  Pth2r_18
gcaggtagagcccttccacc

SEQ ID NO: 50380 - DNA, 20 bp, Artificial Sequence
  sgRNA
  Pth2r_19
agtggcacgagccactctgg

SEQ ID NO: 50381 - DNA, 20 bp, Artificial Sequence
  sgRNA
  Pth2r_20
aaactattactggatcctgg

SEQ ID NO: 50382 - DNA, 20 bp, Artificial Sequence
  sgRNA
  Ptk7_1
gagcgtacaactgtgtacca

SEQ ID NO: 50383 - DNA, 20 bp, Artificial Sequence
  sgRNA
  Ptk7_2
tgttgttgtagcaaggaacg

SEQ ID NO: 50384 - DNA, 20 bp, Artificial Sequence
  sgRNA
  Ptk7_3
cttgcgcatcaatagtgtgg

SEQ ID NO: 50385 - DNA, 20 bp, Artificial Sequence
  sgRNA
  Ptk7_4
tgtctgtcacccattcaggg

SEQ ID NO: 50386 - DNA, 20 bp, Artificial Sequence
  sgRNA
  Ptk7_5
tgagtactaccacttccgcc

SEQ ID NO: 50387 - DNA, 20 bp, Artificial Sequence
  sgRNA
  Ptk7_6
ccgtcagctggacatgagcg

SEQ ID NO: 50388 - DNA, 20 bp, Artificial Sequence
  sgRNA
  Ptk7_7
tctgtccctgaccgatgcaa

SEQ ID NO: 50389 - DNA, 20 bp, Artificial Sequence
  sgRNA
  Ptk7_8
gcaggcgtctaccgttgcat

SEQ ID NO: 50390 - DNA, 20 bp, Artificial Sequence
  sgRNA
  Ptk7_9
gctcgactcccgcagcccga

SEQ ID NO: 50391 - DNA, 20 bp, Artificial Sequence
  sgRNA
  Ptk7_10
gcccgtacccacttaaccgt

SEQ ID NO: 50392 - DNA, 20 bp, Artificial Sequence
  sgRNA
  Ptk7_11
cgttatcccgagccacacac

SEQ ID NO: 50393 - DNA, 20 bp, Artificial Sequence
  sgRNA
  Ptk7_12
cagaccatcgggctgtcggt

SEQ ID NO: 50394 - DNA, 20 bp, Artificial Sequence
  sgRNA
  Ptk7_13
tcagccggtagagcttagac

SEQ ID NO: 50395 - DNA, 20 bp, Artificial Sequence
  sgRNA
  Ptk7_14
tctgcgttggatgtctccag

SEQ ID NO: 50396 - DNA, 20 bp, Artificial Sequence
  sgRNA
  Ptk7_15
cgctcatgtccagctgacgg

SEQ ID NO: 50397 - DNA, 20 bp, Artificial Sequence
  sgRNA
  Ptk7_16
actcatggagagatgcccca

SEQ ID NO: 50398 - DNA, 20 bp, Artificial Sequence
  sgRNA
  Ptk7_17
gggcgtagaggaaggcgcga

SEQ ID NO: 50399 - DNA, 20 bp, Artificial Sequence
  sgRNA
  Ptk7_18
cggtagacgcctgcattccg

SEQ ID NO: 50400 - DNA, 20 bp, Artificial Sequence
  sgRNA
  Ptk7_19
cgaacatctccacctctctc

SEQ ID NO: 50401 - DNA, 20 bp, Artificial Sequence
  sgRNA
  Ptk7_20
ccggagcctccacttcacaa

SEQ ID NO: 50402 - DNA, 20 bp, Artificial Sequence
  sgRNA
  Ptpra_1
ctgtaaccctcagtacgcag

SEQ ID NO: 50403 - DNA, 20 bp, Artificial Sequence
  sgRNA
  Ptpra_2
aaacacgattactagcagag

SEQ ID NO: 50404 - DNA, 20 bp, Artificial Sequence
  sgRNA
  Ptpra_3
tggcctggataggacaagca

SEQ ID NO: 50405 - DNA, 20 bp, Artificial Sequence
  sgRNA
  Ptpra_4
agacacacggacattcccat

SEQ ID NO: 50406 - DNA, 20 bp, Artificial Sequence
  sgRNA
  Ptpra_5
gatgcattcggaacgcaaag

SEQ ID NO: 50407 - DNA, 20 bp, Artificial Sequence
  sgRNA
  Ptpra_6
ccgcctgtcaaatggccgca

SEQ ID NO: 50408 - DNA, 20 bp, Artificial Sequence
  sgRNA
  Ptpra_7
tcaataagccagcttccgtt

SEQ ID NO: 50409 - DNA, 20 bp, Artificial Sequence
  sgRNA
  Ptpra_8
ggcactaccatttccccgaa

SEQ ID NO: 50410 - DNA, 20 bp, Artificial Sequence
  sgRNA
  Ptpra_9
gtgatcattccagtcaaacg

SEQ ID NO: 50411 - DNA, 20 bp, Artificial Sequence
  sgRNA
  Ptpra_10
cctgtcaaatggccgcacgg

SEQ ID NO: 50412 - DNA, 20 bp, Artificial Sequence
  sgRNA
  Ptpra_11
tgtcatggtgaccaacctga

SEQ ID NO: 50413 - DNA, 20 bp, Artificial Sequence
  sgRNA
  Ptpra_12
cgatagcccctgcgtactga

SEQ ID NO: 50414 - DNA, 20 bp, Artificial Sequence
  sgRNA
  Ptpra_13
cctcctggtcaccaacacca

SEQ ID NO: 50415 - DNA, 20 bp, Artificial Sequence
  sgRNA
  Ptpra_14
gccaccatcaccgcaataat

SEQ ID NO: 50416 - DNA, 20 bp, Artificial Sequence
  sgRNA
  Ptpra_15
cctcaatcgtgtggagaaga

SEQ ID NO: 50417 - DNA, 20 bp, Artificial Sequence
  sgRNA
  Ptpra_16
cactccagaaaccttccccc

SEQ ID NO: 50418 - DNA, 20 bp, Artificial Sequence
  sgRNA
  Ptpra_17
ccagaaaccttccccccggc

SEQ ID NO: 50419 - DNA, 20 bp, Artificial Sequence
  sgRNA
  Ptpra_18
gcagccagcacggaatctgg

SEQ ID NO: 50420 - DNA, 20 bp, Artificial Sequence
  sgRNA
  Ptpra_19
ttaacagtagtcacataggt

SEQ ID NO: 50421 - DNA, 20 bp, Artificial Sequence
  sgRNA
  Ptpra_20
ccgtgcggccatttgacagg

SEQ ID NO: 50422 - DNA, 20 bp, Artificial Sequence
  sgRNA
  Ptprb_1
tggggatgttgatcagtacg

SEQ ID NO: 50423 - DNA, 20 bp, Artificial Sequence
  sgRNA
  Ptprb_2
catcgttcaagacacaaacg

SEQ ID NO: 50424 - DNA, 20 bp, Artificial Sequence
  sgRNA
  Ptprb_3
ttgttgagagcggaaatctg

SEQ ID NO: 50425 - DNA, 20 bp, Artificial Sequence
  sgRNA
  Ptprb_4
agaaaccagatagatgcgct

SEQ ID NO: 50426 - DNA, 20 bp, Artificial Sequence
  sgRNA
  Ptprb_5
gtagagccattgatatacac

SEQ ID NO: 50427 - DNA, 20 bp, Artificial Sequence
  sgRNA
  Ptprb_6
tctacagcagtgatacctcg

SEQ ID NO: 50428 - DNA, 20 bp, Artificial Sequence
  sgRNA
  Ptprb_7
tgcaagccactccttcaccg

SEQ ID NO: 50429 - DNA, 20 bp, Artificial Sequence
  sgRNA
  Ptprb_8
acctgcacgtcaacaaccaa

SEQ ID NO: 50430 - DNA, 20 bp, Artificial Sequence
  sgRNA
  Ptprb_9
ggttaccatcagcctatccg

SEQ ID NO: 50431 - DNA, 20 bp, Artificial Sequence
  sgRNA
  Ptprb_10
ggagatccctccactcaccg

SEQ ID NO: 50432 - DNA, 20 bp, Artificial Sequence
  sgRNA
  Ptprb_11
gacgttgtagaggcggcccg

SEQ ID NO: 50433 - DNA, 20 bp, Artificial Sequence
  sgRNA
  Ptprb_12
tggagaagtggatcactacg

SEQ ID NO: 50434 - DNA, 20 bp, Artificial Sequence
  sgRNA
  Ptprb_13
gctgccgtgaaccatctcaa

SEQ ID NO: 50435 - DNA, 20 bp, Artificial Sequence
  sgRNA
  Ptprb_14
gttcagcgacaccaacggag

SEQ ID NO: 50436 - DNA, 20 bp, Artificial Sequence
  sgRNA
  Ptprb_15
gctgagttcaccctccgagg

SEQ ID NO: 50437 - DNA, 20 bp, Artificial Sequence
  sgRNA
  Ptprb_16
tgaaggtgacaaatgacggg

SEQ ID NO: 50438 - DNA, 20 bp, Artificial Sequence
  sgRNA
  Ptprb_17
atagaagtcaaagtccccgg

SEQ ID NO: 50439 - DNA, 20 bp, Artificial Sequence
  sgRNA
  Ptprb_18
gtatctttctgccacaccaa

SEQ ID NO: 50440 - DNA, 20 bp, Artificial Sequence
  sgRNA
  Ptprb_19
gctgtctgtcgtgttccgat

SEQ ID NO: 50441 - DNA, 20 bp, Artificial Sequence
  sgRNA
  Ptprb_20
ggactccgtggacatttatg

SEQ ID NO: 50442 - DNA, 20 bp, Artificial Sequence
  sgRNA
  Ptprc_1
gtagcagaaatcttatatcg

SEQ ID NO: 50443 - DNA, 20 bp, Artificial Sequence
  sgRNA
  Ptprc_2
tttcacaatggagtgtacga

SEQ ID NO: 50444 - DNA, 20 bp, Artificial Sequence
  sgRNA
  Ptprc_3
ttgtcaagctaaggcgacag

SEQ ID NO: 50445 - DNA, 20 bp, Artificial Sequence
  sgRNA
  Ptprc_4
accacaacgaagcaaacatg

SEQ ID NO: 50446 - DNA, 20 bp, Artificial Sequence
  sgRNA
  Ptprc_5
gggccactaaaagaaacgat

SEQ ID NO: 50447 - DNA, 20 bp, Artificial Sequence
  sgRNA
  Ptprc_6
actattgtctgtcggccggg

SEQ ID NO: 50448 - DNA, 20 bp, Artificial Sequence
  sgRNA
  Ptprc_7
tcatcaactgtctcatcccg

SEQ ID NO: 50449 - DNA, 20 bp, Artificial Sequence
  sgRNA
  Ptprc_8
tattcagaggaccatctgga

SEQ ID NO: 50450 - DNA, 20 bp, Artificial Sequence
  sgRNA
  Ptprc_9
acactcacgcctgctcccgg

SEQ ID NO: 50451 - DNA, 20 bp, Artificial Sequence
  sgRNA
  Ptprc_10
ggaaacttgctgaatacccg

SEQ ID NO: 50452 - DNA, 20 bp, Artificial Sequence
  sgRNA
  Ptprc_11
gagtctgcatctaaacccca

SEQ ID NO: 50453 - DNA, 20 bp, Artificial Sequence
  sgRNA
  Ptprc_12
tggtcctctgaataaagccc

SEQ ID NO: 50454 - DNA, 20 bp, Artificial Sequence
  sgRNA
  Ptprc_13
gctaactgtgtccgtccaga

SEQ ID NO: 50455 - DNA, 20 bp, Artificial Sequence
  sgRNA
  Ptprc_14
gggccattagtttcataagg

SEQ ID NO: 50456 - DNA, 20 bp, Artificial Sequence
  sgRNA
  Ptprc_15
taaagtctctacgcaaagca

SEQ ID NO: 50457 - DNA, 20 bp, Artificial Sequence
  sgRNA
  Ptprc_16
atagatttatatgtaccacc

SEQ ID NO: 50458 - DNA, 20 bp, Artificial Sequence
  sgRNA
  Ptprc_17
acctgctcctcaaacttcga

SEQ ID NO: 50459 - DNA, 20 bp, Artificial Sequence
  sgRNA
  Ptprc_18
gcagctggatccccacaact

SEQ ID NO: 50460 - DNA, 20 bp, Artificial Sequence
  sgRNA
  Ptprc_19
ggtcctgaatcatagacacc

SEQ ID NO: 50461 - DNA, 20 bp, Artificial Sequence
  sgRNA
  Ptprc_20
caggggagaggactgtaccg

SEQ ID NO: 50462 - DNA, 20 bp, Artificial Sequence
  sgRNA
  Ptprd_1
gttccagaagaaataccaac

SEQ ID NO: 50463 - DNA, 20 bp, Artificial Sequence
  sgRNA
  Ptprd_2
gcaatggtatctgatcgtgg

SEQ ID NO: 50464 - DNA, 20 bp, Artificial Sequence
  sgRNA
  Ptprd_3
catgcctcagtatatcctga

SEQ ID NO: 50465 - DNA, 20 bp, Artificial Sequence
  sgRNA
  Ptprd_4
cattgcatacgatcactccc

SEQ ID NO: 50466 - DNA, 20 bp, Artificial Sequence
  sgRNA
  Ptprd_5
tgcgtgcctgaacatcccgt

SEQ ID NO: 50467 - DNA, 20 bp, Artificial Sequence
  sgRNA
  Ptprd_6
atggaaaatggcgagccgaa

SEQ ID NO: 50468 - DNA, 20 bp, Artificial Sequence
  sgRNA
  Ptprd_7
gtgtgcctgcagcctatccg

SEQ ID NO: 50469 - DNA, 20 bp, Artificial Sequence
  sgRNA
  Ptprd_8
gtatagagtttattatacaa

SEQ ID NO: 50470 - DNA, 20 bp, Artificial Sequence
  sgRNA
  Ptprd_9
gcgtgcctgaacatcccgtg

SEQ ID NO: 50471 - DNA, 20 bp, Artificial Sequence
  sgRNA
  Ptprd_10
gtgcctttgaagaagtcgcg

SEQ ID NO: 50472 - DNA, 20 bp, Artificial Sequence
  sgRNA
  Ptprd_11
ccagatccattgacacaaca

SEQ ID NO: 50473 - DNA, 20 bp, Artificial Sequence
  sgRNA
  Ptprd_12
gtacaactaatatcttgagg

SEQ ID NO: 50474 - DNA, 20 bp, Artificial Sequence
  sgRNA
  Ptprd_13
tctaggacatttcgtcctat

SEQ ID NO: 50475 - DNA, 20 bp, Artificial Sequence
  sgRNA
  Ptprd_14
tgcctttgaagaagtcgcgt

SEQ ID NO: 50476 - DNA, 20 bp, Artificial Sequence
  sgRNA
  Ptprd_15
gcgggcccatatcaatcgta

SEQ ID NO: 50477 - DNA, 20 bp, Artificial Sequence
  sgRNA
  Ptprd_16
cgagccgcactagaatacct

SEQ ID NO: 50478 - DNA, 20 bp, Artificial Sequence
  sgRNA
  Ptprd_17
gttgacacaagcaacaacaa

SEQ ID NO: 50479 - DNA, 20 bp, Artificial Sequence
  sgRNA
  Ptprd_18
ttgccacgataactgaacag

SEQ ID NO: 50480 - DNA, 20 bp, Artificial Sequence
  sgRNA
  Ptprd_19
tatgccatatgaatccacaa

SEQ ID NO: 50481 - DNA, 20 bp, Artificial Sequence
  sgRNA
  Ptprd_20
tggtcctcctcgaaaagtcg

SEQ ID NO: 50482 - DNA, 20 bp, Artificial Sequence
  sgRNA
  Ptprf_1
gggttcccgactatcgacat

SEQ ID NO: 50483 - DNA, 20 bp, Artificial Sequence
  sgRNA
  Ptprf_2
ggcagcgagccggaagacgt

SEQ ID NO: 50484 - DNA, 20 bp, Artificial Sequence
  sgRNA
  Ptprf_3
ctgtacacctgactagcgag

SEQ ID NO: 50485 - DNA, 20 bp, Artificial Sequence
  sgRNA
  Ptprf_4
cgaagaccgtaagcgacatg

SEQ ID NO: 50486 - DNA, 20 bp, Artificial Sequence
  sgRNA
  Ptprf_5
gtttgccaagaatttccgtg

SEQ ID NO: 50487 - DNA, 20 bp, Artificial Sequence
  sgRNA
  Ptprf_6
aacgaagtactgatagcgag

SEQ ID NO: 50488 - DNA, 20 bp, Artificial Sequence
  sgRNA
  Ptprf_7
ctaccgtctccaataccggc

SEQ ID NO: 50489 - DNA, 20 bp, Artificial Sequence
  sgRNA
  Ptprf_8
ataccagctgtgctaccgtg

SEQ ID NO: 50490 - DNA, 20 bp, Artificial Sequence
  sgRNA
  Ptprf_9
cgtctttgttaaggtccccg

SEQ ID NO: 50491 - DNA, 20 bp, Artificial Sequence
  sgRNA
  Ptprf_10
gaaagagatcaccacccccg

SEQ ID NO: 50492 - DNA, 20 bp, Artificial Sequence
  sgRNA
  Ptprf_11
gctaccgtctccaataccgg

SEQ ID NO: 50493 - DNA, 20 bp, Artificial Sequence
  sgRNA
  Ptprf_12
gatcagtattggccagtccg

SEQ ID NO: 50494 - DNA, 20 bp, Artificial Sequence
  sgRNA
  Ptprf_13
cctgtaacccactagatgcg

SEQ ID NO: 50495 - DNA, 20 bp, Artificial Sequence
  sgRNA
  Ptprf_14
ccagtatgtgttcatccacg

SEQ ID NO: 50496 - DNA, 20 bp, Artificial Sequence
  sgRNA
  Ptprf_15
gcggccatcctctataaagg

SEQ ID NO: 50497 - DNA, 20 bp, Artificial Sequence
  sgRNA
  Ptprf_16
tcttcatcgcagcggccaca

SEQ ID NO: 50498 - DNA, 20 bp, Artificial Sequence
  sgRNA
  Ptprf_17
aggcctacatagctacacag

SEQ ID NO: 50499 - DNA, 20 bp, Artificial Sequence
  sgRNA
  Ptprf_18
aacccaagcctcgaattacg

SEQ ID NO: 50500 - DNA, 20 bp, Artificial Sequence
  sgRNA
  Ptprf_19
tgccatgtgcggacacaccg

SEQ ID NO: 50501 - DNA, 20 bp, Artificial Sequence
  sgRNA
  Ptprf_20
gggaggcgagaacgaagcac

SEQ ID NO: 50502 - DNA, 20 bp, Artificial Sequence
  sgRNA
  Ptprg_1
taaaaagcctatgtcccgag

SEQ ID NO: 50503 - DNA, 20 bp, Artificial Sequence
  sgRNA
  Ptprg_2
tccactatttcactacaggg

SEQ ID NO: 50504 - DNA, 20 bp, Artificial Sequence
  sgRNA
  Ptprg_3
agcatagtgtcaatggccgg

SEQ ID NO: 50505 - DNA, 20 bp, Artificial Sequence
  sgRNA
  Ptprg_4
ggcacttcacgggaacgtcg

SEQ ID NO: 50506 - DNA, 20 bp, Artificial Sequence
  sgRNA
  Ptprg_5
gcaccgacgaaggacagcga

SEQ ID NO: 50507 - DNA, 20 bp, Artificial Sequence
  sgRNA
  Ptprg_6
gtacctgtaataactcccca

SEQ ID NO: 50508 - DNA, 20 bp, Artificial Sequence
  sgRNA
  Ptprg_7
gtaccctcgctgtccttcgt

SEQ ID NO: 50509 - DNA, 20 bp, Artificial Sequence
  sgRNA
  Ptprg_8
gttcctttcatcccgggcaa

SEQ ID NO: 50510 - DNA, 20 bp, Artificial Sequence
  sgRNA
  Ptprg_9
gatccactccatcctcccgg

SEQ ID NO: 50511 - DNA, 20 bp, Artificial Sequence
  sgRNA
  Ptprg_10
ccgaggccttagcttcccct

SEQ ID NO: 50512 - DNA, 20 bp, Artificial Sequence
  sgRNA
  Ptprg_11
tgatccactccatcctcccg

SEQ ID NO: 50513 - DNA, 20 bp, Artificial Sequence
  sgRNA
  Ptprg_12
cctattatccacgggctgaa

SEQ ID NO: 50514 - DNA, 20 bp, Artificial Sequence
  sgRNA
  Ptprg_13
gagactccatgctctctgca

SEQ ID NO: 50515 - DNA, 20 bp, Artificial Sequence
  sgRNA
  Ptprg_14
ctttcgttggggaccacccg

SEQ ID NO: 50516 - DNA, 20 bp, Artificial Sequence
  sgRNA
  Ptprg_15
gctcattctgacgacctttg

SEQ ID NO: 50517 - DNA, 20 bp, Artificial Sequence
  sgRNA
  Ptprg_16
gatccaagtctggggcaacg

SEQ ID NO: 50518 - DNA, 20 bp, Artificial Sequence
  sgRNA
  Ptprg_17
ctaaaaagcctatgtcccga

SEQ ID NO: 50519 - DNA, 20 bp, Artificial Sequence
  sgRNA
  Ptprg_18
aggctgagaccacaatcagg

SEQ ID NO: 50520 - DNA, 20 bp, Artificial Sequence
  sgRNA
  Ptprg_19
ttagaggcttctgtgcctag

SEQ ID NO: 50521 - DNA, 20 bp, Artificial Sequence
  sgRNA
  Ptprg_20
ccaaaggtcgtcagaatgag

SEQ ID NO: 50522 - DNA, 20 bp, Artificial Sequence
  sgRNA
  Ptprh_1
atggtggccaaactgagacc

SEQ ID NO: 50523 - DNA, 20 bp, Artificial Sequence
  sgRNA
  Ptprh_2
agctggctcaagatctgaca

SEQ ID NO: 50524 - DNA, 20 bp, Artificial Sequence
  sgRNA
  Ptprh_3
aacagacaccagtattaccg

SEQ ID NO: 50525 - DNA, 20 bp, Artificial Sequence
  sgRNA
  Ptprh_4
cagattcctgtaaccaccgc

SEQ ID NO: 50526 - DNA, 20 bp, Artificial Sequence
  sgRNA
  Ptprh_5
gcagttggtcagcataacca

SEQ ID NO: 50527 - DNA, 20 bp, Artificial Sequence
  sgRNA
  Ptprh_6
gggttgcaatgaactccttg

SEQ ID NO: 50528 - DNA, 20 bp, Artificial Sequence
  sgRNA
  Ptprh_7
tcacccacagtgttaggcag

SEQ ID NO: 50529 - DNA, 20 bp, Artificial Sequence
  sgRNA
  Ptprh_8
catctttcggaaagccagca

SEQ ID NO: 50530 - DNA, 20 bp, Artificial Sequence
  sgRNA
  Ptprh_9
atgcaaggctgagcatccaa

SEQ ID NO: 50531 - DNA, 20 bp, Artificial Sequence
  sgRNA
  Ptprh_10
gcgttgatatagtcagagcc

SEQ ID NO: 50532 - DNA, 20 bp, Artificial Sequence
  sgRNA
  Ptprh_11
ccaaggccagtctcaaataa

SEQ ID NO: 50533 - DNA, 20 bp, Artificial Sequence
  sgRNA
  Ptprh_12
gagagctttgaggtaaaagt

SEQ ID NO: 50534 - DNA, 20 bp, Artificial Sequence
  sgRNA
  Ptprh_13
ccagtctcaaataacggcat

SEQ ID NO: 50535 - DNA, 20 bp, Artificial Sequence
  sgRNA
  Ptprh_14
gtaccagtgtcacagtggac

SEQ ID NO: 50536 - DNA, 20 bp, Artificial Sequence
  sgRNA
  Ptprh_15
aaggagttcattgcaaccca

SEQ ID NO: 50537 - DNA, 20 bp, Artificial Sequence
  sgRNA
  Ptprh_16
ctttggccaggatatcccct

SEQ ID NO: 50538 - DNA, 20 bp, Artificial Sequence
  sgRNA
  Ptprh_17
tccgaaagatgcttcggcaa

SEQ ID NO: 50539 - DNA, 20 bp, Artificial Sequence
  sgRNA
  Ptprh_18
ggctggagctggcttctgga

SEQ ID NO: 50540 - DNA, 20 bp, Artificial Sequence
  sgRNA
  Ptprh_19
gagcctggttcctcttggag

SEQ ID NO: 50541 - DNA, 20 bp, Artificial Sequence
  sgRNA
  Ptprh_20
tcctgcatcagcacttctgg

SEQ ID NO: 50542 - DNA, 20 bp, Artificial Sequence
  sgRNA
  Ptprj_1
actgaccgatgtaatattag

SEQ ID NO: 50543 - DNA, 20 bp, Artificial Sequence
  sgRNA
  Ptprj_2
cctggaaaagcaattacgat

SEQ ID NO: 50544 - DNA, 20 bp, Artificial Sequence
  sgRNA
  Ptprj_3
agacaccagggattaactca

SEQ ID NO: 50545 - DNA, 20 bp, Artificial Sequence
  sgRNA
  Ptprj_4
gagtgacaaatgtcagcaca

SEQ ID NO: 50546 - DNA, 20 bp, Artificial Sequence
  sgRNA
  Ptprj_5
gaagtcagagacctgatcgg

SEQ ID NO: 50547 - DNA, 20 bp, Artificial Sequence
  sgRNA
  Ptprj_6
tggagatcagacactggcca

SEQ ID NO: 50548 - DNA, 20 bp, Artificial Sequence
  sgRNA
  Ptprj_7
ccgcggccttagactcgcag

SEQ ID NO: 50549 - DNA, 20 bp, Artificial Sequence
  sgRNA
  Ptprj_8
ggcgatgctgatgttgtacg

SEQ ID NO: 50550 - DNA, 20 bp, Artificial Sequence
  sgRNA
  Ptprj_9
tggatcccctaatattacat

SEQ ID NO: 50551 - DNA, 20 bp, Artificial Sequence
  sgRNA
  Ptprj_10
ccctcggctactacaacggg

SEQ ID NO: 50552 - DNA, 20 bp, Artificial Sequence
  sgRNA
  Ptprj_11
gtatgtgacataagtatccg

SEQ ID NO: 50553 - DNA, 20 bp, Artificial Sequence
  sgRNA
  Ptprj_12
cctcccgttgtagtagccga

SEQ ID NO: 50554 - DNA, 20 bp, Artificial Sequence
  sgRNA
  Ptprj_13
gataaggacggagtaggcat

SEQ ID NO: 50555 - DNA, 20 bp, Artificial Sequence
  sgRNA
  Ptprj_14
gtacagaacagattccaacc

SEQ ID NO: 50556 - DNA, 20 bp, Artificial Sequence
  sgRNA
  Ptprj_15
caaatggcactgcctcctac

SEQ ID NO: 50557 - DNA, 20 bp, Artificial Sequence
  sgRNA
  Ptprj_16
ccagaagtggaccagatcca

SEQ ID NO: 50558 - DNA, 20 bp, Artificial Sequence
  sgRNA
  Ptprj_17
gcctcccgttgtagtagccg

SEQ ID NO: 50559 - DNA, 20 bp, Artificial Sequence
  sgRNA
  Ptprj_18
acgcctagagaactgcactt

SEQ ID NO: 50560 - DNA, 20 bp, Artificial Sequence
  sgRNA
  Ptprj_19
ctgctgctgttgctacgcca

SEQ ID NO: 50561 - DNA, 20 bp, Artificial Sequence
  sgRNA
  Ptprj_20
ccacaagccttgctggccca

SEQ ID NO: 50562 - DNA, 20 bp, Artificial Sequence
  sgRNA
  Ptprk_1
taccagaacgccctaagtgg

SEQ ID NO: 50563 - DNA, 20 bp, Artificial Sequence
  sgRNA
  Ptprk_2
tgcgtaactcagtcagaacg

SEQ ID NO: 50564 - DNA, 20 bp, Artificial Sequence
  sgRNA
  Ptprk_3
acctaccgcaaggataactc

SEQ ID NO: 50565 - DNA, 20 bp, Artificial Sequence
  sgRNA
  Ptprk_4
agaagcgcaaagatgcaatg

SEQ ID NO: 50566 - DNA, 20 bp, Artificial Sequence
  sgRNA
  Ptprk_5
gtcttcagcttgtagtcgag

SEQ ID NO: 50567 - DNA, 20 bp, Artificial Sequence
  sgRNA
  Ptprk_6
gtatttatgcatcttcaccc

SEQ ID NO: 50568 - DNA, 20 bp, Artificial Sequence
  sgRNA
  Ptprk_7
gttctgactgagttacgcag

SEQ ID NO: 50569 - DNA, 20 bp, Artificial Sequence
  sgRNA
  Ptprk_8
gtgttccataccacgcaaca

SEQ ID NO: 50570 - DNA, 20 bp, Artificial Sequence
  sgRNA
  Ptprk_9
agtcatcgtataaatcctgg

SEQ ID NO: 50571 - DNA, 20 bp, Artificial Sequence
  sgRNA
  Ptprk_10
gatgttgtatcctttgcggg

SEQ ID NO: 50572 - DNA, 20 bp, Artificial Sequence
  sgRNA
  Ptprk_11
gctgcacccagccatcaggg

SEQ ID NO: 50573 - DNA, 20 bp, Artificial Sequence
  sgRNA
  Ptprk_12
tgcttaccagacctggcgaa

SEQ ID NO: 50574 - DNA, 20 bp, Artificial Sequence
  sgRNA
  Ptprk_13
cgagcctgctcccttcaccg

SEQ ID NO: 50575 - DNA, 20 bp, Artificial Sequence
  sgRNA
  Ptprk_14
cagtaagtcggccaccctga

SEQ ID NO: 50576 - DNA, 20 bp, Artificial Sequence
  sgRNA
  Ptprk_15
gatttgactggcacaggccc

SEQ ID NO: 50577 - DNA, 20 bp, Artificial Sequence
  sgRNA
  Ptprk_16
tgctctggtcagcataactt

SEQ ID NO: 50578 - DNA, 20 bp, Artificial Sequence
  sgRNA
  Ptprk_17
gcgatatggtcctatccaag

SEQ ID NO: 50579 - DNA, 20 bp, Artificial Sequence
  sgRNA
  Ptprk_18
caattactatgacaaccagc

SEQ ID NO: 50580 - DNA, 20 bp, Artificial Sequence
  sgRNA
  Ptprk_19
agatgttgtatcctttgcgg

SEQ ID NO: 50581 - DNA, 20 bp, Artificial Sequence
  sgRNA
  Ptprk_20
tgactctccggataaatgac

SEQ ID NO: 50582 - DNA, 20 bp, Artificial Sequence
  sgRNA
  Ptprm_1
agagccgacacaaacatatg

SEQ ID NO: 50583 - DNA, 20 bp, Artificial Sequence
  sgRNA
  Ptprm_2
gtagtgaaagtcgatgcagt

SEQ ID NO: 50584 - DNA, 20 bp, Artificial Sequence
  sgRNA
  Ptprm_3
taaaaaatagatcccatgcg

SEQ ID NO: 50585 - DNA, 20 bp, Artificial Sequence
  sgRNA
  Ptprm_4
caaaattgactgtgtccgag

SEQ ID NO: 50586 - DNA, 20 bp, Artificial Sequence
  sgRNA
  Ptprm_5
ccatacttataagaaacgcg

SEQ ID NO: 50587 - DNA, 20 bp, Artificial Sequence
  sgRNA
  Ptprm_6
cttccgtgcaaatcatgcag

SEQ ID NO: 50588 - DNA, 20 bp, Artificial Sequence
  sgRNA
  Ptprm_7
cttattctgatgaacccgga

SEQ ID NO: 50589 - DNA, 20 bp, Artificial Sequence
  sgRNA
  Ptprm_8
tcgacaaatcaccatccgct

SEQ ID NO: 50590 - DNA, 20 bp, Artificial Sequence
  sgRNA
  Ptprm_9
tgtgataagaacgtttgccg

SEQ ID NO: 50591 - DNA, 20 bp, Artificial Sequence
  sgRNA
  Ptprm_10
cattggctcgactagcagct

SEQ ID NO: 50592 - DNA, 20 bp, Artificial Sequence
  sgRNA
  Ptprm_11
cttcctgcggattcagaacg

SEQ ID NO: 50593 - DNA, 20 bp, Artificial Sequence
  sgRNA
  Ptprm_12
tgtatccaaacggctcccag

SEQ ID NO: 50594 - DNA, 20 bp, Artificial Sequence
  sgRNA
  Ptprm_13
ctgcagacacgaattccacc

SEQ ID NO: 50595 - DNA, 20 bp, Artificial Sequence
  sgRNA
  Ptprm_14
gacagtttcacttcaccggc

SEQ ID NO: 50596 - DNA, 20 bp, Artificial Sequence
  sgRNA
  Ptprm_15
gcagcatcgcactcctaccc

SEQ ID NO: 50597 - DNA, 20 bp, Artificial Sequence
  sgRNA
  Ptprm_16
acacgaccaagagagacgct

SEQ ID NO: 50598 - DNA, 20 bp, Artificial Sequence
  sgRNA
  Ptprm_17
cctgcggattcagaacgtgg

SEQ ID NO: 50599 - DNA, 20 bp, Artificial Sequence
  sgRNA
  Ptprm_18
gctccgacaccagagaactg

SEQ ID NO: 50600 - DNA, 20 bp, Artificial Sequence
  sgRNA
  Ptprm_19
ggtgacaataagacatacaa

SEQ ID NO: 50601 - DNA, 20 bp, Artificial Sequence
  sgRNA
  Ptprm_20
gctgctcaaccatttaccat

SEQ ID NO: 50602 - DNA, 20 bp, Artificial Sequence
  sgRNA
  Ptprn_1
gtaagcagcactgagcgcat

SEQ ID NO: 50603 - DNA, 20 bp, Artificial Sequence
  sgRNA
  Ptprn_2
aaagtccctgtttaaccggg

SEQ ID NO: 50604 - DNA, 20 bp, Artificial Sequence
  sgRNA
  Ptprn_3
ctggtcacggacatgctcca

SEQ ID NO: 50605 - DNA, 20 bp, Artificial Sequence
  sgRNA
  Ptprn_4
accctccgcccggttaaaca

SEQ ID NO: 50606 - DNA, 20 bp, Artificial Sequence
  sgRNA
  Ptprn_5
agagctgcgtcagttgaccc

SEQ ID NO: 50607 - DNA, 20 bp, Artificial Sequence
  sgRNA
  Ptprn_6
gatgttgataaagctaccgg

SEQ ID NO: 50608 - DNA, 20 bp, Artificial Sequence
  sgRNA
  Ptprn_7
acggccatcagctcgaccat

SEQ ID NO: 50609 - DNA, 20 bp, Artificial Sequence
  sgRNA
  Ptprn_8
atcagctcgaccatcggccg

SEQ ID NO: 50610 - DNA, 20 bp, Artificial Sequence
  sgRNA
  Ptprn_9
tgacatggtcctgaatcgca

SEQ ID NO: 50611 - DNA, 20 bp, Artificial Sequence
  sgRNA
  Ptprn_10
gagttagcaattcccctgca

SEQ ID NO: 50612 - DNA, 20 bp, Artificial Sequence
  sgRNA
  Ptprn_11
gagggtagaaaactgctccg

SEQ ID NO: 50613 - DNA, 20 bp, Artificial Sequence
  sgRNA
  Ptprn_12
tggagcatgtccgtgaccag

SEQ ID NO: 50614 - DNA, 20 bp, Artificial Sequence
  sgRNA
  Ptprn_13
acagtgtgaccgctactggc

SEQ ID NO: 50615 - DNA, 20 bp, Artificial Sequence
  sgRNA
  Ptprn_14
ctatgtaggccggcatccga

SEQ ID NO: 50616 - DNA, 20 bp, Artificial Sequence
  sgRNA
  Ptprn_15
gtgaggtacccaggaagcga

SEQ ID NO: 50617 - DNA, 20 bp, Artificial Sequence
  sgRNA
  Ptprn_16
gatatgccatgggcttgtcg

SEQ ID NO: 50618 - DNA, 20 bp, Artificial Sequence
  sgRNA
  Ptprn_17
ctaactcagggcaatcctac

SEQ ID NO: 50619 - DNA, 20 bp, Artificial Sequence
  sgRNA
  Ptprn_18
gtcctcccagttcagcgacg

SEQ ID NO: 50620 - DNA, 20 bp, Artificial Sequence
  sgRNA
  Ptprn_19
tatcccgctgtctcgaatga

SEQ ID NO: 50621 - DNA, 20 bp, Artificial Sequence
  sgRNA
  Ptprn_20
ccagatgcgaacaaagtctg

SEQ ID NO: 50622 - DNA, 20 bp, Artificial Sequence
  sgRNA
  Ptprn2_1
ctcaccatcatccatactcg

SEQ ID NO: 50623 - DNA, 20 bp, Artificial Sequence
  sgRNA
  Ptprn2_2
agatcacagactatcagagg

SEQ ID NO: 50624 - DNA, 20 bp, Artificial Sequence
  sgRNA
  Ptprn2_3
tgctgatgtgtgggccacgt

SEQ ID NO: 50625 - DNA, 20 bp, Artificial Sequence
  sgRNA
  Ptprn2_4
caaggcctacctatggcatg

SEQ ID NO: 50626 - DNA, 20 bp, Artificial Sequence
  sgRNA
  Ptprn2_5
gtagggcagatagcgccgaa

SEQ ID NO: 50627 - DNA, 20 bp, Artificial Sequence
  sgRNA
  Ptprn2_6
caacctctaccatgtctacg

SEQ ID NO: 50628 - DNA, 20 bp, Artificial Sequence
  sgRNA
  Ptprn2_7
ggatgacccagtgtacaagg

SEQ ID NO: 50629 - DNA, 20 bp, Artificial Sequence
  sgRNA
  Ptprn2_8
agtatcctgataaccttctg

SEQ ID NO: 50630 - DNA, 20 bp, Artificial Sequence
  sgRNA
  Ptprn2_9
gaaccatgtacaaggtaccg

SEQ ID NO: 50631 - DNA, 20 bp, Artificial Sequence
  sgRNA
  Ptprn2_10
taccgatatgaggtaccacc

SEQ ID NO: 50632 - DNA, 20 bp, Artificial Sequence
  sgRNA
  Ptprn2_11
ggatgaagaaagcctcaaat

SEQ ID NO: 50633 - DNA, 20 bp, Artificial Sequence
  sgRNA
  Ptprn2_12
ccagctgtaggcctccacta

SEQ ID NO: 50634 - DNA, 20 bp, Artificial Sequence
  sgRNA
  Ptprn2_13
ttacagaagctctcccgtac

SEQ ID NO: 50635 - DNA, 20 bp, Artificial Sequence
  sgRNA
  Ptprn2_14
cgagccgaaggactaggcat

SEQ ID NO: 50636 - DNA, 20 bp, Artificial Sequence
  sgRNA
  Ptprn2_15
agaatgctgacaatgaaaaa

SEQ ID NO: 50637 - DNA, 20 bp, Artificial Sequence
  sgRNA
  Ptprn2_16
gcagaccaacgagactcgca

SEQ ID NO: 50638 - DNA, 20 bp, Artificial Sequence
  sgRNA
  Ptprn2_17
ggagctatgccgccagcgta

SEQ ID NO: 50639 - DNA, 20 bp, Artificial Sequence
  sgRNA
  Ptprn2_18
ctatgtcaccgtctaccttg

SEQ ID NO: 50640 - DNA, 20 bp, Artificial Sequence
  sgRNA
  Ptprn2_19
gggtctcctctcttacctga

SEQ ID NO: 50641 - DNA, 20 bp, Artificial Sequence
  sgRNA
  Ptprn2_20
tgacctatcctcctgcaacc

SEQ ID NO: 50642 - DNA, 20 bp, Artificial Sequence
  sgRNA
  Ptpro_1
cggaagttgtagtaccacgc

SEQ ID NO: 50643 - DNA, 20 bp, Artificial Sequence
  sgRNA
  Ptpro_2
agtagctgtgtcgtcccacg

SEQ ID NO: 50644 - DNA, 20 bp, Artificial Sequence
  sgRNA
  Ptpro_3
cacaccactgtactccacaa

SEQ ID NO: 50645 - DNA, 20 bp, Artificial Sequence
  sgRNA
  Ptpro_4
acactgagaccacactcgat

SEQ ID NO: 50646 - DNA, 20 bp, Artificial Sequence
  sgRNA
  Ptpro_5
gattgttacgacgttccacg

SEQ ID NO: 50647 - DNA, 20 bp, Artificial Sequence
  sgRNA
  Ptpro_6
cttcctattgaatcttgcgg

SEQ ID NO: 50648 - DNA, 20 bp, Artificial Sequence
  sgRNA
  Ptpro_7
atagtaggtcgtccactctg

SEQ ID NO: 50649 - DNA, 20 bp, Artificial Sequence
  sgRNA
  Ptpro_8
tacagaggtgaaccctaacg

SEQ ID NO: 50650 - DNA, 20 bp, Artificial Sequence
  sgRNA
  Ptpro_9
cgaagtcatccagctgaacg

SEQ ID NO: 50651 - DNA, 20 bp, Artificial Sequence
  sgRNA
  Ptpro_10
gcaaatgtcacaggatcgga

SEQ ID NO: 50652 - DNA, 20 bp, Artificial Sequence
  sgRNA
  Ptpro_11
ggatggtcgttgcagaaggg

SEQ ID NO: 50653 - DNA, 20 bp, Artificial Sequence
  sgRNA
  Ptpro_12
agattgtagatatctcctgg

SEQ ID NO: 50654 - DNA, 20 bp, Artificial Sequence
  sgRNA
  Ptpro_13
cgtgatttctggagcaacgg

SEQ ID NO: 50655 - DNA, 20 bp, Artificial Sequence
  sgRNA
  Ptpro_14
gatgcactgtcccaccagaa

SEQ ID NO: 50656 - DNA, 20 bp, Artificial Sequence
  sgRNA
  Ptpro_15
gcgctcataccgaatgtcaa

SEQ ID NO: 50657 - DNA, 20 bp, Artificial Sequence
  sgRNA
  Ptpro_16
ccgagatcaccaccacgtta

SEQ ID NO: 50658 - DNA, 20 bp, Artificial Sequence
  sgRNA
  Ptpro_17
cggtggttgagcttaagacg

SEQ ID NO: 50659 - DNA, 20 bp, Artificial Sequence
  sgRNA
  Ptpro_18
ggctggagatggtcaccacg

SEQ ID NO: 50660 - DNA, 20 bp, Artificial Sequence
  sgRNA
  Ptpro_19
gagtctccggagtttcttcg

SEQ ID NO: 50661 - DNA, 20 bp, Artificial Sequence
  sgRNA
  Ptpro_20
ccgagtctcacaggcccccg

SEQ ID NO: 50662 - DNA, 20 bp, Artificial Sequence
  sgRNA
  Ptprq_1
caagagaagtaatagccacg

SEQ ID NO: 50663 - DNA, 20 bp, Artificial Sequence
  sgRNA
  Ptprq_2
gtttgatttacagatcgtgg

SEQ ID NO: 50664 - DNA, 20 bp, Artificial Sequence
  sgRNA
  Ptprq_3
gaaagtggttaacctcacag

SEQ ID NO: 50665 - DNA, 20 bp, Artificial Sequence
  sgRNA
  Ptprq_4
atctacagtagtcatctgga

SEQ ID NO: 50666 - DNA, 20 bp, Artificial Sequence
  sgRNA
  Ptprq_5
tgaaggacgagagattaacg

SEQ ID NO: 50667 - DNA, 20 bp, Artificial Sequence
  sgRNA
  Ptprq_6
tgaagtttcagccgttacga

SEQ ID NO: 50668 - DNA, 20 bp, Artificial Sequence
  sgRNA
  Ptprq_7
ataccctgcttccgtcgtaa

SEQ ID NO: 50669 - DNA, 20 bp, Artificial Sequence
  sgRNA
  Ptprq_8
gatgcgtaaacacaaaccgg

SEQ ID NO: 50670 - DNA, 20 bp, Artificial Sequence
  sgRNA
  Ptprq_9
cagccgttacgacggaagca

SEQ ID NO: 50671 - DNA, 20 bp, Artificial Sequence
  sgRNA
  Ptprq_10
gttgtatatgaacgaagcca

SEQ ID NO: 50672 - DNA, 20 bp, Artificial Sequence
  sgRNA
  Ptprq_11
gatcccccattaaagccaaa

SEQ ID NO: 50673 - DNA, 20 bp, Artificial Sequence
  sgRNA
  Ptprq_12
cagctgatattgataccaaa

SEQ ID NO: 50674 - DNA, 20 bp, Artificial Sequence
  sgRNA
  Ptprq_13
tacactttaacaataccgcc

SEQ ID NO: 50675 - DNA, 20 bp, Artificial Sequence
  sgRNA
  Ptprq_14
acgccaccatctcaaccaaa

SEQ ID NO: 50676 - DNA, 20 bp, Artificial Sequence
  sgRNA
  Ptprq_15
tcctcctgaaaatgttcgcg

SEQ ID NO: 50677 - DNA, 20 bp, Artificial Sequence
  sgRNA
  Ptprq_16
gttgaattatatgggccaac

SEQ ID NO: 50678 - DNA, 20 bp, Artificial Sequence
  sgRNA
  Ptprq_17
ggatgtctccatcaaagtag

SEQ ID NO: 50679 - DNA, 20 bp, Artificial Sequence
  sgRNA
  Ptprq_18
gctgcggcaagaactatgaa

SEQ ID NO: 50680 - DNA, 20 bp, Artificial Sequence
  sgRNA
  Ptprq_19
actcctcctgtaaaacctaa

SEQ ID NO: 50681 - DNA, 20 bp, Artificial Sequence
  sgRNA
  Ptprq_20
gcctccagtcttcctagccg

SEQ ID NO: 50682 - DNA, 20 bp, Artificial Sequence
  sgRNA
  Ptprr_1
agcagcaaatgtgattgtgg

SEQ ID NO: 50683 - DNA, 20 bp, Artificial Sequence
  sgRNA
  Ptprr_2
gaatggtcataaatgaacac

SEQ ID NO: 50684 - DNA, 20 bp, Artificial Sequence
  sgRNA
  Ptprr_3
gagacacaaacaactcaacc

SEQ ID NO: 50685 - DNA, 20 bp, Artificial Sequence
  sgRNA
  Ptprr_4
ggcgccaaaggtgctgaacg

SEQ ID NO: 50686 - DNA, 20 bp, Artificial Sequence
  sgRNA
  Ptprr_5
ctactggtacacttcatggc

SEQ ID NO: 50687 - DNA, 20 bp, Artificial Sequence
  sgRNA
  Ptprr_6
ctttaagacgaggttgcgga

SEQ ID NO: 50688 - DNA, 20 bp, Artificial Sequence
  sgRNA
  Ptprr_7
ttgtggccgtctcaaccccc

SEQ ID NO: 50689 - DNA, 20 bp, Artificial Sequence
  sgRNA
  Ptprr_8
catggctaccttctcccggg

SEQ ID NO: 50690 - DNA, 20 bp, Artificial Sequence
  sgRNA
  Ptprr_9
tgaccgtgtgagaactcggc

SEQ ID NO: 50691 - DNA, 20 bp, Artificial Sequence
  sgRNA
  Ptprr_10
cctatgggcttcattctgaa

SEQ ID NO: 50692 - DNA, 20 bp, Artificial Sequence
  sgRNA
  Ptprr_11
ccatggctaccttctcccgg

SEQ ID NO: 50693 - DNA, 20 bp, Artificial Sequence
  sgRNA
  Ptprr_12
gttatcacattcggtcacac

SEQ ID NO: 50694 - DNA, 20 bp, Artificial Sequence
  sgRNA
  Ptprr_13
gggctgcagctactccttgg

SEQ ID NO: 50695 - DNA, 20 bp, Artificial Sequence
  sgRNA
  Ptprr_14
tctactggccagaaaagaga

SEQ ID NO: 50696 - DNA, 20 bp, Artificial Sequence
  sgRNA
  Ptprr_15
tccacctatcacccattgca

SEQ ID NO: 50697 - DNA, 20 bp, Artificial Sequence
  sgRNA
  Ptprr_16
ttggcggaagatccgaagca

SEQ ID NO: 50698 - DNA, 20 bp, Artificial Sequence
  sgRNA
  Ptprr_17
cagccaacagattaagagac

SEQ ID NO: 50699 - DNA, 20 bp, Artificial Sequence
  sgRNA
  Ptprr_18
cccttcagaatgaagcccat

SEQ ID NO: 50700 - DNA, 20 bp, Artificial Sequence
  sgRNA
  Ptprr_19
ctatgatgataaagatgctg

SEQ ID NO: 50701 - DNA, 20 bp, Artificial Sequence
  sgRNA
  Ptprr_20
tgtggccgtctcaacccccc

SEQ ID NO: 50702 - DNA, 20 bp, Artificial Sequence
  sgRNA
  Ptprs_1
atgatgtccttgatgcgcgg

SEQ ID NO: 50703 - DNA, 20 bp, Artificial Sequence
  sgRNA
  Ptprs_2
caattacgtagtaggacacg

SEQ ID NO: 50704 - DNA, 20 bp, Artificial Sequence
  sgRNA
  Ptprs_3
agaagcgtggggccacacgg

SEQ ID NO: 50705 - DNA, 20 bp, Artificial Sequence
  sgRNA
  Ptprs_4
atggagccggaacacccagt

SEQ ID NO: 50706 - DNA, 20 bp, Artificial Sequence
  sgRNA
  Ptprs_5
gctgtcaactccattggcca

SEQ ID NO: 50707 - DNA, 20 bp, Artificial Sequence
  sgRNA
  Ptprs_6
gcttgagcggatgcgctacg

SEQ ID NO: 50708 - DNA, 20 bp, Artificial Sequence
  sgRNA
  Ptprs_7
gaccaatactggcctaaccg

SEQ ID NO: 50709 - DNA, 20 bp, Artificial Sequence
  sgRNA
  Ptprs_8
cctgaggatgacatgcccgt

SEQ ID NO: 50710 - DNA, 20 bp, Artificial Sequence
  sgRNA
  Ptprs_9
agcatgatgtccttgatgcg

SEQ ID NO: 50711 - DNA, 20 bp, Artificial Sequence
  sgRNA
  Ptprs_10
tcgtacacgttctcatcccg

SEQ ID NO: 50712 - DNA, 20 bp, Artificial Sequence
  sgRNA
  Ptprs_11
cagacacgcgagctctcgta

SEQ ID NO: 50713 - DNA, 20 bp, Artificial Sequence
  sgRNA
  Ptprs_12
tcagtatggcttcatccacg

SEQ ID NO: 50714 - DNA, 20 bp, Artificial Sequence
  sgRNA
  Ptprs_13
aatttcgtgctcaccaaccg

SEQ ID NO: 50715 - DNA, 20 bp, Artificial Sequence
  sgRNA
  Ptprs_14
gccccgttgtgagtttctgg

SEQ ID NO: 50716 - DNA, 20 bp, Artificial Sequence
  sgRNA
  Ptprs_15
gcacaaagaggacatagcgg

SEQ ID NO: 50717 - DNA, 20 bp, Artificial Sequence
  sgRNA
  Ptprs_16
gcgcgtgctcgccttcacgt

SEQ ID NO: 50718 - DNA, 20 bp, Artificial Sequence
  sgRNA
  Ptprs_17
cgtgaactggaactgtcgga

SEQ ID NO: 50719 - DNA, 20 bp, Artificial Sequence
  sgRNA
  Ptprs_18
gcgtataccatgaaaggcga

SEQ ID NO: 50720 - DNA, 20 bp, Artificial Sequence
  sgRNA
  Ptprs_19
accccagtgccagcaacggg

SEQ ID NO: 50721 - DNA, 20 bp, Artificial Sequence
  sgRNA
  Ptprs_20
gtacacggtgtccgtgcggg

SEQ ID NO: 50722 - DNA, 20 bp, Artificial Sequence
  sgRNA
  Ptprt_1
acctcccaatgagaccaatg

SEQ ID NO: 50723 - DNA, 20 bp, Artificial Sequence
  sgRNA
  Ptprt_2
caaagtagtgtagcgaatcg

SEQ ID NO: 50724 - DNA, 20 bp, Artificial Sequence
  sgRNA
  Ptprt_3
cctgcgactccaaaacgttg

SEQ ID NO: 50725 - DNA, 20 bp, Artificial Sequence
  sgRNA
  Ptprt_4
acagggtcacaagtccggta

SEQ ID NO: 50726 - DNA, 20 bp, Artificial Sequence
  sgRNA
  Ptprt_5
gttccagcctgccatccggg

SEQ ID NO: 50727 - DNA, 20 bp, Artificial Sequence
  sgRNA
  Ptprt_6
tgggttgcaatgtagtgccg

SEQ ID NO: 50728 - DNA, 20 bp, Artificial Sequence
  sgRNA
  Ptprt_7
ggggatagctcatctctaca

SEQ ID NO: 50729 - DNA, 20 bp, Artificial Sequence
  sgRNA
  Ptprt_8
gcagcattgggctcttaccc

SEQ ID NO: 50730 - DNA, 20 bp, Artificial Sequence
  sgRNA
  Ptprt_9
gttgaagcaggtccgccacc

SEQ ID NO: 50731 - DNA, 20 bp, Artificial Sequence
  sgRNA
  Ptprt_10
gcaatccgagtagtgactgg

SEQ ID NO: 50732 - DNA, 20 bp, Artificial Sequence
  sgRNA
  Ptprt_11
tgatgctgaccatcaaaagg

SEQ ID NO: 50733 - DNA, 20 bp, Artificial Sequence
  sgRNA
  Ptprt_12
tcctctcgagtccatccaag

SEQ ID NO: 50734 - DNA, 20 bp, Artificial Sequence
  sgRNA
  Ptprt_13
aggtgaatggtggaccccaa

SEQ ID NO: 50735 - DNA, 20 bp, Artificial Sequence
  sgRNA
  Ptprt_14
tacagggtcacaagtccggt

SEQ ID NO: 50736 - DNA, 20 bp, Artificial Sequence
  sgRNA
  Ptprt_15
cgtcatggtcacaaaccttg

SEQ ID NO: 50737 - DNA, 20 bp, Artificial Sequence
  sgRNA
  Ptprt_16
gaggcagagtggagtccccg

SEQ ID NO: 50738 - DNA, 20 bp, Artificial Sequence
  sgRNA
  Ptprt_17
gcatcctctacccaacacgg

SEQ ID NO: 50739 - DNA, 20 bp, Artificial Sequence
  sgRNA
  Ptprt_18
ctgctactgtccaaccctga

SEQ ID NO: 50740 - DNA, 20 bp, Artificial Sequence
  sgRNA
  Ptprt_19
gatgggaccataacacccgg

SEQ ID NO: 50741 - DNA, 20 bp, Artificial Sequence
  sgRNA
  Ptprt_20
ccatctactgagatgaggaa

SEQ ID NO: 50742 - DNA, 20 bp, Artificial Sequence
  sgRNA
  Ptpru_1
ttgtgagaatcagacgcacg

SEQ ID NO: 50743 - DNA, 20 bp, Artificial Sequence
  sgRNA
  Ptpru_2
gcgaagcggtggtgtcaccg

SEQ ID NO: 50744 - DNA, 20 bp, Artificial Sequence
  sgRNA
  Ptpru_3
atcgagtaccgcatggcacg

SEQ ID NO: 50745 - DNA, 20 bp, Artificial Sequence
  sgRNA
  Ptpru_4
ggatccggtcatattccaca

SEQ ID NO: 50746 - DNA, 20 bp, Artificial Sequence
  sgRNA
  Ptpru_5
acgcacggagaacagatacg

SEQ ID NO: 50747 - DNA, 20 bp, Artificial Sequence
  sgRNA
  Ptpru_6
gtgtcccctaccacgccacg

SEQ ID NO: 50748 - DNA, 20 bp, Artificial Sequence
  sgRNA
  Ptpru_7
ggtcaacatgatccagacgg

SEQ ID NO: 50749 - DNA, 20 bp, Artificial Sequence
  sgRNA
  Ptpru_8
gcggatcatctccaagaccg

SEQ ID NO: 50750 - DNA, 20 bp, Artificial Sequence
  sgRNA
  Ptpru_9
gtaccacgcccgacttctgg

SEQ ID NO: 50751 - DNA, 20 bp, Artificial Sequence
  sgRNA
  Ptpru_10
gttgacccgtcgggaacaga

SEQ ID NO: 50752 - DNA, 20 bp, Artificial Sequence
  sgRNA
  Ptpru_11
ttaaccagtccaactccgcc

SEQ ID NO: 50753 - DNA, 20 bp, Artificial Sequence
  sgRNA
  Ptpru_12
cggttcttgtctcgattccg

SEQ ID NO: 50754 - DNA, 20 bp, Artificial Sequence
  sgRNA
  Ptpru_13
atagcaaagggacacagcgt

SEQ ID NO: 50755 - DNA, 20 bp, Artificial Sequence
  sgRNA
  Ptpru_14
gatccgctgtcacagcctgg

SEQ ID NO: 50756 - DNA, 20 bp, Artificial Sequence
  sgRNA
  Ptpru_15
gtgttctcggactcgcccag

SEQ ID NO: 50757 - DNA, 20 bp, Artificial Sequence
  sgRNA
  Ptpru_16
ctcctggcggtagttgaccg

SEQ ID NO: 50758 - DNA, 20 bp, Artificial Sequence
  sgRNA
  Ptpru_17
gctccaccctgcagtccgag

SEQ ID NO: 50759 - DNA, 20 bp, Artificial Sequence
  sgRNA
  Ptpru_18
acgggtcaacatgatccaga

SEQ ID NO: 50760 - DNA, 20 bp, Artificial Sequence
  sgRNA
  Ptpru_19
gcatcgggtgtagtttcaca

SEQ ID NO: 50761 - DNA, 20 bp, Artificial Sequence
  sgRNA
  Ptpru_20
tgaggccatgcccttcaccg

SEQ ID NO: 50762 - DNA, 20 bp, Artificial Sequence
  sgRNA
  Ptprz1_1
atggcgtcataaacgacccg

SEQ ID NO: 50763 - DNA, 20 bp, Artificial Sequence
  sgRNA
  Ptprz1_2
atctacaagaaatgccccag

SEQ ID NO: 50764 - DNA, 20 bp, Artificial Sequence
  sgRNA
  Ptprz1_3
gtccgaagcagcacgagtag

SEQ ID NO: 50765 - DNA, 20 bp, Artificial Sequence
  sgRNA
  Ptprz1_4
catgtgattatagtgagtcg

SEQ ID NO: 50766 - DNA, 20 bp, Artificial Sequence
  sgRNA
  Ptprz1_5
acaggagctgaacgcacgcg

SEQ ID NO: 50767 - DNA, 20 bp, Artificial Sequence
  sgRNA
  Ptprz1_6
gctactttgttcaacctggg

SEQ ID NO: 50768 - DNA, 20 bp, Artificial Sequence
  sgRNA
  Ptprz1_7
ataccccaggatctaaagcg

SEQ ID NO: 50769 - DNA, 20 bp, Artificial Sequence
  sgRNA
  Ptprz1_8
acacaaatgcctttcgaacg

SEQ ID NO: 50770 - DNA, 20 bp, Artificial Sequence
  sgRNA
  Ptprz1_9
acatcgacagaaccatgcag

SEQ ID NO: 50771 - DNA, 20 bp, Artificial Sequence
  sgRNA
  Ptprz1_10
aatactggctggaacccccc

SEQ ID NO: 50772 - DNA, 20 bp, Artificial Sequence
  sgRNA
  Ptprz1_11
tggtgtagatattactcgag

SEQ ID NO: 50773 - DNA, 20 bp, Artificial Sequence
  sgRNA
  Ptprz1_12
gagtgcccactagtaacaga

SEQ ID NO: 50774 - DNA, 20 bp, Artificial Sequence
  sgRNA
  Ptprz1_13
gttgagtcgtctgcgaatgg

SEQ ID NO: 50775 - DNA, 20 bp, Artificial Sequence
  sgRNA
  Ptprz1_14
agtacatcagaagcaagcgt

SEQ ID NO: 50776 - DNA, 20 bp, Artificial Sequence
  sgRNA
  Ptprz1_15
gttgcggcctcatagagcaa

SEQ ID NO: 50777 - DNA, 20 bp, Artificial Sequence
  sgRNA
  Ptprz1_16
gcaagtctactgctttgatg

SEQ ID NO: 50778 - DNA, 20 bp, Artificial Sequence
  sgRNA
  Ptprz1_17
aggaggttctgcaagacgaa

SEQ ID NO: 50779 - DNA, 20 bp, Artificial Sequence
  sgRNA
  Ptprz1_18
ggtggtgtagatattactcg

SEQ ID NO: 50780 - DNA, 20 bp, Artificial Sequence
  sgRNA
  Ptprz1_19
gcagaactgtaagaaacagt

SEQ ID NO: 50781 - DNA, 20 bp, Artificial Sequence
  sgRNA
  Ptprz1_20
cttgccctatagagaatccc

SEQ ID NO: 50782 - DNA, 20 bp, Artificial Sequence
  sgRNA
  Pttg1ip_1
cgtgtatggactacccagtg

SEQ ID NO: 50783 - DNA, 20 bp, Artificial Sequence
  sgRNA
  Pttg1ip_2
aaattgagttccgctcgctg

SEQ ID NO: 50784 - DNA, 20 bp, Artificial Sequence
  sgRNA
  Pttg1ip_3
ccgaggagcatcacccagtg

SEQ ID NO: 50785 - DNA, 20 bp, Artificial Sequence
  sgRNA
  Pttg1ip_4
gcgcaggaacctccgagagt

SEQ ID NO: 50786 - DNA, 20 bp, Artificial Sequence
  sgRNA
  Pttg1ip_5
gcaacagcagcacggcaccg

SEQ ID NO: 50787 - DNA, 20 bp, Artificial Sequence
  sgRNA
  Pttg1ip_6
ggtcattatggatagagata

SEQ ID NO: 50788 - DNA, 20 bp, Artificial Sequence
  sgRNA
  Pttg1ip_7
gcttccggctcttcttccgg

SEQ ID NO: 50789 - DNA, 20 bp, Artificial Sequence
  sgRNA
  Pttg1ip_8
gtaaattgagttccgctcgc

SEQ ID NO: 50790 - DNA, 20 bp, Artificial Sequence
  sgRNA
  Pttg1ip_9
ggacagaagcaacagcagca

SEQ ID NO: 50791 - DNA, 20 bp, Artificial Sequence
  sgRNA
  Pttg1ip_10
gctgccgccggaagaagagc

SEQ ID NO: 50792 - DNA, 20 bp, Artificial Sequence
  sgRNA
  Pttg1ip_11
ccagcatacgccccagcgag

SEQ ID NO: 50793 - DNA, 20 bp, Artificial Sequence
  sgRNA
  Pttg1ip_12
tctcggaggttcctgcgcgg

SEQ ID NO: 50794 - DNA, 20 bp, Artificial Sequence
  sgRNA
  Pttg1ip_13
atcaccatgtcggtcctggg

SEQ ID NO: 50795 - DNA, 20 bp, Artificial Sequence
  sgRNA
  Pttg1ip_14
gcgggccatgagagagcagg

SEQ ID NO: 50796 - DNA, 20 bp, Artificial Sequence
  sgRNA
  Pttg1ip_15
gtgctgctgttgcttctgtc

SEQ ID NO: 50797 - DNA, 20 bp, Artificial Sequence
  sgRNA
  Pttg1ip_16
agccagacaagagcgatgag

SEQ ID NO: 50798 - DNA, 20 bp, Artificial Sequence
  sgRNA
  Pttg1ip_17
ccttgggctgacgccgcact

SEQ ID NO: 50799 - DNA, 20 bp, Artificial Sequence
  sgRNA
  Pttg1ip_18
ggccttgatcatcaccatgt

SEQ ID NO: 50800 - DNA, 20 bp, Artificial Sequence
  sgRNA
  Pttg1ip_19
gatgaaatcaggaaaaaata

SEQ ID NO: 50801 - DNA, 20 bp, Artificial Sequence
  sgRNA
  Pttg1ip_20
aatttacagagagaagcagg

SEQ ID NO: 50802 - DNA, 20 bp, Artificial Sequence
  sgRNA
  Pvr_1
aggtcagggtcaagttagtg

SEQ ID NO: 50803 - DNA, 20 bp, Artificial Sequence
  sgRNA
  Pvr_2
aacttaagtgtagaagacga

SEQ ID NO: 50804 - DNA, 20 bp, Artificial Sequence
  sgRNA
  Pvr_3
gaagacagccacaagagcgt

SEQ ID NO: 50805 - DNA, 20 bp, Artificial Sequence
  sgRNA
  Pvr_4
gctaaatgcatctctgccaa

SEQ ID NO: 50806 - DNA, 20 bp, Artificial Sequence
  sgRNA
  Pvr_5
gcgaagtcaccaatgcccta

SEQ ID NO: 50807 - DNA, 20 bp, Artificial Sequence
  sgRNA
  Pvr_6
cgatgatgatgactacagcg

SEQ ID NO: 50808 - DNA, 20 bp, Artificial Sequence
  sgRNA
  Pvr_7
ctaatctccaccgtagagga

SEQ ID NO: 50809 - DNA, 20 bp, Artificial Sequence
  sgRNA
  Pvr_8
gccaagagattcgtccagga

SEQ ID NO: 50810 - DNA, 20 bp, Artificial Sequence
  sgRNA
  Pvr_9
aagacgcctgtcgaattgta

SEQ ID NO: 50811 - DNA, 20 bp, Artificial Sequence
  sgRNA
  Pvr_10
tcttggccctcgaatgtgaa

SEQ ID NO: 50812 - DNA, 20 bp, Artificial Sequence
  sgRNA
  Pvr_11
tgacttccattcacattcga

SEQ ID NO: 50813 - DNA, 20 bp, Artificial Sequence
  sgRNA
  Pvr_12
attcgacaggcgtcttggga

SEQ ID NO: 50814 - DNA, 20 bp, Artificial Sequence
  sgRNA
  Pvr_13
gctgtcttccaccccaagaa

SEQ ID NO: 50815 - DNA, 20 bp, Artificial Sequence
  sgRNA
  Pvr_14
tgcagtccaatccctcagag

SEQ ID NO: 50816 - DNA, 20 bp, Artificial Sequence
  sgRNA
  Pvr_15
agaggatggtctcaataaca

SEQ ID NO: 50817 - DNA, 20 bp, Artificial Sequence
  sgRNA
  Pvr_16
ctgtcttccaccccaagaag

SEQ ID NO: 50818 - DNA, 20 bp, Artificial Sequence
  sgRNA
  Pvr_17
cagattgccacattccccag

SEQ ID NO: 50819 - DNA, 20 bp, Artificial Sequence
  sgRNA
  Pvr_18
attgagaccatcctctacgg

SEQ ID NO: 50820 - DNA, 20 bp, Artificial Sequence
  sgRNA
  Pvr_19
ggaagacagccacaagagcg

SEQ ID NO: 50821 - DNA, 20 bp, Artificial Sequence
  sgRNA
  Pvr_20
agtcagactacagtgcaagg

SEQ ID NO: 50822 - DNA, 20 bp, Artificial Sequence
  sgRNA
  Qrfpr_1
gtggcagtacactacccgaa

SEQ ID NO: 50823 - DNA, 20 bp, Artificial Sequence
  sgRNA
  Qrfpr_2
gtggcacgtacaacgcctcg

SEQ ID NO: 50824 - DNA, 20 bp, Artificial Sequence
  sgRNA
  Qrfpr_3
tgtcgttatgatggtgacag

SEQ ID NO: 50825 - DNA, 20 bp, Artificial Sequence
  sgRNA
  Qrfpr_4
gatttccgtcacaacagcag

SEQ ID NO: 50826 - DNA, 20 bp, Artificial Sequence
  sgRNA
  Qrfpr_5
tgacttgcatcgctgttgag

SEQ ID NO: 50827 - DNA, 20 bp, Artificial Sequence
  sgRNA
  Qrfpr_6
cagccgggaaaactgctccg

SEQ ID NO: 50828 - DNA, 20 bp, Artificial Sequence
  sgRNA
  Qrfpr_7
tgttctggagcatcgtgacg

SEQ ID NO: 50829 - DNA, 20 bp, Artificial Sequence
  sgRNA
  Qrfpr_8
agtggcagtacactacccga

SEQ ID NO: 50830 - DNA, 20 bp, Artificial Sequence
  sgRNA
  Qrfpr_9
gcgaccgctggtctacactc

SEQ ID NO: 50831 - DNA, 20 bp, Artificial Sequence
  sgRNA
  Qrfpr_10
agagttgccaaagagcgcca

SEQ ID NO: 50832 - DNA, 20 bp, Artificial Sequence
  sgRNA
  Qrfpr_11
tcaaattgtgtgagcagcca

SEQ ID NO: 50833 - DNA, 20 bp, Artificial Sequence
  sgRNA
  Qrfpr_12
agctccggagtgtagaccag

SEQ ID NO: 50834 - DNA, 20 bp, Artificial Sequence
  sgRNA
  Qrfpr_13
caaattgtgtgagcagccag

SEQ ID NO: 50835 - DNA, 20 bp, Artificial Sequence
  sgRNA
  Qrfpr_14
gtaagagaaaccttctcccc

SEQ ID NO: 50836 - DNA, 20 bp, Artificial Sequence
  sgRNA
  Qrfpr_15
gcatcaccacaagcggcagg

SEQ ID NO: 50837 - DNA, 20 bp, Artificial Sequence
  sgRNA
  Qrfpr_16
aggacaagcatcaccacaag

SEQ ID NO: 50838 - DNA, 20 bp, Artificial Sequence
  sgRNA
  Qrfpr_17
aaggccagtttagcgcgcgc

SEQ ID NO: 50839 - DNA, 20 bp, Artificial Sequence
  sgRNA
  Qrfpr_18
acagcagtggactggacgaa

SEQ ID NO: 50840 - DNA, 20 bp, Artificial Sequence
  sgRNA
  Qrfpr_19
cgaagggctttcacaatctt

SEQ ID NO: 50841 - DNA, 20 bp, Artificial Sequence
  sgRNA
  Qrfpr_20
ccaagattgtgaaagccctt

SEQ ID NO: 50842 - DNA, 20 bp, Artificial Sequence
  sgRNA
  Qsox1_1
gcaggcaaaccgatatagtg

SEQ ID NO: 50843 - DNA, 20 bp, Artificial Sequence
  sgRNA
  Qsox1_2
acgcaagatgtagtggagtg

SEQ ID NO: 50844 - DNA, 20 bp, Artificial Sequence
  sgRNA
  Qsox1_3
gcatcgccttcgccccgacg

SEQ ID NO: 50845 - DNA, 20 bp, Artificial Sequence
  sgRNA
  Qsox1_4
ggcgagcgttaaccctgttg

SEQ ID NO: 50846 - DNA, 20 bp, Artificial Sequence
  sgRNA
  Qsox1_5
ttagcaagctccttccacgt

SEQ ID NO: 50847 - DNA, 20 bp, Artificial Sequence
  sgRNA
  Qsox1_6
tgtatccattaccagctcgg

SEQ ID NO: 50848 - DNA, 20 bp, Artificial Sequence
  sgRNA
  Qsox1_7
gctctggactagccacaaca

SEQ ID NO: 50849 - DNA, 20 bp, Artificial Sequence
  sgRNA
  Qsox1_8
gctcaagtgttgctgcccgg

SEQ ID NO: 50850 - DNA, 20 bp, Artificial Sequence
  sgRNA
  Qsox1_9
gaatgggtggagcttcacca

SEQ ID NO: 50851 - DNA, 20 bp, Artificial Sequence
  sgRNA
  Qsox1_10
atatgcaggagaatgccccc

SEQ ID NO: 50852 - DNA, 20 bp, Artificial Sequence
  sgRNA
  Qsox1_11
ggtggagcttcaccagggca

SEQ ID NO: 50853 - DNA, 20 bp, Artificial Sequence
  sgRNA
  Qsox1_12
ggcccccaagaactatacac

SEQ ID NO: 50854 - DNA, 20 bp, Artificial Sequence
  sgRNA
  Qsox1_13
ggggctacctggactgacca

SEQ ID NO: 50855 - DNA, 20 bp, Artificial Sequence
  sgRNA
  Qsox1_14
gtcttccctttcaaagacca

SEQ ID NO: 50856 - DNA, 20 bp, Artificial Sequence
  sgRNA
  Qsox1_15
ggtggccctgaaaaagtttg

SEQ ID NO: 50857 - DNA, 20 bp, Artificial Sequence
  sgRNA
  Qsox1_16
gcagctttgaagaaactgta

SEQ ID NO: 50858 - DNA, 20 bp, Artificial Sequence
  sgRNA
  Qsox1_17
tctggaccaaaggctgccca

SEQ ID NO: 50859 - DNA, 20 bp, Artificial Sequence
  sgRNA
  Qsox1_18
gcagtgagccacacttccgg

SEQ ID NO: 50860 - DNA, 20 bp, Artificial Sequence
  sgRNA
  Qsox1_19
tcttgcattccataaacgac

SEQ ID NO: 50861 - DNA, 20 bp, Artificial Sequence
  sgRNA
  Qsox1_20
gatgcagtggccacaccagg

SEQ ID NO: 50862 - DNA, 20 bp, Artificial Sequence
  sgRNA
  Qsox2_1
tggtgcagttccactcgtcg

SEQ ID NO: 50863 - DNA, 20 bp, Artificial Sequence
  sgRNA
  Qsox2_2
gaggagaaaaacgatcgtag

SEQ ID NO: 50864 - DNA, 20 bp, Artificial Sequence
  sgRNA
  Qsox2_3
agaagtggatgtcatatgtg

SEQ ID NO: 50865 - DNA, 20 bp, Artificial Sequence
  sgRNA
  Qsox2_4
gggatgtcaaggaagtcgat

SEQ ID NO: 50866 - DNA, 20 bp, Artificial Sequence
  sgRNA
  Qsox2_5
gtggaactgcaccagccacg

SEQ ID NO: 50867 - DNA, 20 bp, Artificial Sequence
  sgRNA
  Qsox2_6
gggatccaggagcttatgcg

SEQ ID NO: 50868 - DNA, 20 bp, Artificial Sequence
  sgRNA
  Qsox2_7
gcaaaggtcttaacccctca

SEQ ID NO: 50869 - DNA, 20 bp, Artificial Sequence
  sgRNA
  Qsox2_8
caccgtctcttcgagccgcg

SEQ ID NO: 50870 - DNA, 20 bp, Artificial Sequence
  sgRNA
  Qsox2_9
agtgtgaaacagtttccaga

SEQ ID NO: 50871 - DNA, 20 bp, Artificial Sequence
  sgRNA
  Qsox2_10
gcgagggctcagacgccgtg

SEQ ID NO: 50872 - DNA, 20 bp, Artificial Sequence
  sgRNA
  Qsox2_11
cgggcaacagctcagccgcg

SEQ ID NO: 50873 - DNA, 20 bp, Artificial Sequence
  sgRNA
  Qsox2_12
aagaagaaacttcctccaca

SEQ ID NO: 50874 - DNA, 20 bp, Artificial Sequence
  sgRNA
  Qsox2_13
caacatggtaaacagccgcc

SEQ ID NO: 50875 - DNA, 20 bp, Artificial Sequence
  sgRNA
  Qsox2_14
ccacagagtatgcgtccacc

SEQ ID NO: 50876 - DNA, 20 bp, Artificial Sequence
  sgRNA
  Qsox2_15
ctatagcagggacaacctgg

SEQ ID NO: 50877 - DNA, 20 bp, Artificial Sequence
  sgRNA
  Qsox2_16
tcagagtgaggtccaagcga

SEQ ID NO: 50878 - DNA, 20 bp, Artificial Sequence
  sgRNA
  Qsox2_17
agtggccgcaccacgacgag

SEQ ID NO: 50879 - DNA, 20 bp, Artificial Sequence
  sgRNA
  Qsox2_18
gcatcggctacgcacccacc

SEQ ID NO: 50880 - DNA, 20 bp, Artificial Sequence
  sgRNA
  Qsox2_19
gagaagccaaccccaaggaa

SEQ ID NO: 50881 - DNA, 20 bp, Artificial Sequence
  sgRNA
  Qsox2_20
tctggacatgagcctctgcg

SEQ ID NO: 50882 - DNA, 20 bp, Artificial Sequence
  sgRNA
  Raet1d_1
agatgaagtgaagtgcttcg

SEQ ID NO: 50883 - DNA, 20 bp, Artificial Sequence
  sgRNA
  Raet1d_2
gaactcaccatctagcccgt

SEQ ID NO: 50884 - DNA, 20 bp, Artificial Sequence
  sgRNA
  Raet1d_3
tctacacagagattatgagc

SEQ ID NO: 50885 - DNA, 20 bp, Artificial Sequence
  sgRNA
  Raet1d_4
cagcaaatgccactgaagtg

SEQ ID NO: 50886 - DNA, 20 bp, Artificial Sequence
  sgRNA
  Raet1d_5
gcacttcacttcatctgctg

SEQ ID NO: 50887 - DNA, 20 bp, Artificial Sequence
  sgRNA
  Raet1d_6
tggcatttgctgtctcccct

SEQ ID NO: 50888 - DNA, 20 bp, Artificial Sequence
  sgRNA
  Raet1d_7
ttagaagtagagtggctggt

SEQ ID NO: 50889 - DNA, 20 bp, Artificial Sequence
  sgRNA
  Raet1d_8
agatttgtgccagaagttga

SEQ ID NO: 50890 - DNA, 20 bp, Artificial Sequence
  sgRNA
  Raet1d_9
catgacttcaggtgacccag

SEQ ID NO: 50891 - DNA, 20 bp, Artificial Sequence
  sgRNA
  Raet1d_10
caattgaaattcttgataca

SEQ ID NO: 50892 - DNA, 20 bp, Artificial Sequence
  sgRNA
  Raet1d_11
acacggatgcagtcagaaaa

SEQ ID NO: 50893 - DNA, 20 bp, Artificial Sequence
  sgRNA
  Raet1d_12
gtggctggtaggtggaagcg

SEQ ID NO: 50894 - DNA, 20 bp, Artificial Sequence
  sgRNA
  Raet1d_13
gatgaagtgaagtgcttcgt

SEQ ID NO: 50895 - DNA, 20 bp, Artificial Sequence
  sgRNA
  Raet1d_14
taaacattcccccacttcag

SEQ ID NO: 50896 - DNA, 20 bp, Artificial Sequence
  sgRNA
  Raet1d_15
tgtttatgttacttaaatgg

SEQ ID NO: 50897 - DNA, 20 bp, Artificial Sequence
  sgRNA
  Raet1d_16
agcacttcacttcatctgct

SEQ ID NO: 50898 - DNA, 20 bp, Artificial Sequence
  sgRNA
  Raet1d_17
gctcataatctctgtgtaga

SEQ ID NO: 50899 - DNA, 20 bp, Artificial Sequence
  sgRNA
  Raet1d_18
tcttgtttatgttacttaaa

SEQ ID NO: 50900 - DNA, 20 bp, Artificial Sequence
  sgRNA
  Raet1d_19
agcaaatgccactgaagtgg

SEQ ID NO: 50901 - DNA, 20 bp, Artificial Sequence
  sgRNA
  Raet1d_20
ttctggcacaaatctttcag

SEQ ID NO: 50902 - DNA, 20 bp, Artificial Sequence
  sgRNA
  Raet1e_1
gagcacttcacgtcacacca

SEQ ID NO: 50903 - DNA, 20 bp, Artificial Sequence
  sgRNA
  Raet1e_2
tcctggcacaaatcgttcag

SEQ ID NO: 50904 - DNA, 20 bp, Artificial Sequence
  sgRNA
  Raet1e_3
gaactcaccatccagcccgt

SEQ ID NO: 50905 - DNA, 20 bp, Artificial Sequence
  sgRNA
  Raet1e_4
tctacacagagaatatgagc

SEQ ID NO: 50906 - DNA, 20 bp, Artificial Sequence
  sgRNA
  Raet1e_5
gtgtgacgtgaagtgctcag

SEQ ID NO: 50907 - DNA, 20 bp, Artificial Sequence
  sgRNA
  Raet1e_6
ttgtgtcaaacatttgccag

SEQ ID NO: 50908 - DNA, 20 bp, Artificial Sequence
  sgRNA
  Raet1e_7
ctatggatacaccaacgggc

SEQ ID NO: 50909 - DNA, 20 bp, Artificial Sequence
  sgRNA
  Raet1e_8
tggcatttgccatcttccct

SEQ ID NO: 50910 - DNA, 20 bp, Artificial Sequence
  sgRNA
  Raet1e_9
ctacctcagcagaccttccc

SEQ ID NO: 50911 - DNA, 20 bp, Artificial Sequence
  sgRNA
  Raet1e_10
acctctgaacgatttgtgcc

SEQ ID NO: 50912 - DNA, 20 bp, Artificial Sequence
  sgRNA
  Raet1e_11
ttagaagtagagtggctggg

SEQ ID NO: 50913 - DNA, 20 bp, Artificial Sequence
  sgRNA
  Raet1e_12
gggaagatggcaaatgccac

SEQ ID NO: 50914 - DNA, 20 bp, Artificial Sequence
  sgRNA
  Raet1e_13
acttcacgtcacaccaggga

SEQ ID NO: 50915 - DNA, 20 bp, Artificial Sequence
  sgRNA
  Raet1e_14
cgatttgtgccaggagttga

SEQ ID NO: 50916 - DNA, 20 bp, Artificial Sequence
  sgRNA
  Raet1e_15
tgtttatgttatttaaatgg

SEQ ID NO: 50917 - DNA, 20 bp, Artificial Sequence
  sgRNA
  Raet1e_16
agtatttcaattgttgcaca

SEQ ID NO: 50918 - DNA, 20 bp, Artificial Sequence
  sgRNA
  Raet1e_17
tgagcacttcacgtcacacc

SEQ ID NO: 50919 - DNA, 20 bp, Artificial Sequence
  sgRNA
  Raet1e_18
gctcatattctctgtgtaga

SEQ ID NO: 50920 - DNA, 20 bp, Artificial Sequence
  sgRNA
  Raet1e_19
gagtggctgggaggtggaag

SEQ ID NO: 50921 - DNA, 20 bp, Artificial Sequence
  sgRNA
  Raet1e_20
gtggctgggaggtggaagcg

SEQ ID NO: 50922 - DNA, 20 bp, Artificial Sequence
  sgRNA
  Ramp2_1
gaatcaatctcatcccactg

SEQ ID NO: 50923 - DNA, 20 bp, Artificial Sequence
  sgRNA
  Ramp2_2
ttggtgtgacccgcgcccag

SEQ ID NO: 50924 - DNA, 20 bp, Artificial Sequence
  sgRNA
  Ramp2_3
accaagccgagatccacccg

SEQ ID NO: 50925 - DNA, 20 bp, Artificial Sequence
  sgRNA
  Ramp2_4
ctccggaagagattggttca

SEQ ID NO: 50926 - DNA, 20 bp, Artificial Sequence
  sgRNA
  Ramp2_5
ggttccggactcctctcggg

SEQ ID NO: 50927 - DNA, 20 bp, Artificial Sequence
  sgRNA
  Ramp2_6
gcacaacgctgtcggccgct

SEQ ID NO: 50928 - DNA, 20 bp, Artificial Sequence
  sgRNA
  Ramp2_7
gtatgagtacaagagttgca

SEQ ID NO: 50929 - DNA, 20 bp, Artificial Sequence
  sgRNA
  Ramp2_8
tccacaccacaagagtaaca

SEQ ID NO: 50930 - DNA, 20 bp, Artificial Sequence
  sgRNA
  Ramp2_9
acaccaagccgagatccacc

SEQ ID NO: 50931 - DNA, 20 bp, Artificial Sequence
  sgRNA
  Ramp2_10
acactttgcgaactgctccc

SEQ ID NO: 50932 - DNA, 20 bp, Artificial Sequence
  sgRNA
  Ramp2_11
ccacaagagtaacaaggaac

SEQ ID NO: 50933 - DNA, 20 bp, Artificial Sequence
  sgRNA
  Ramp2_12
agtaggaagcagcattaagt

SEQ ID NO: 50934 - DNA, 20 bp, Artificial Sequence
  sgRNA
  Ramp2_13
gcagcagcagcaacagcgga

SEQ ID NO: 50935 - DNA, 20 bp, Artificial Sequence
  sgRNA
  Ramp2_14
tctgggggatcagagaaggt

SEQ ID NO: 50936 - DNA, 20 bp, Artificial Sequence
  sgRNA
  Ramp2_15
gccaggagcacatcctctgg

SEQ ID NO: 50937 - DNA, 20 bp, Artificial Sequence
  sgRNA
  Ramp2_16
caccaagccgagatccaccc

SEQ ID NO: 50938 - DNA, 20 bp, Artificial Sequence
  sgRNA
  Ramp2_17
atacatctctgggttggcgc

SEQ ID NO: 50939 - DNA, 20 bp, Artificial Sequence
  sgRNA
  Ramp2_18
gggctgacagcacagcagaa

SEQ ID NO: 50940 - DNA, 20 bp, Artificial Sequence
  sgRNA
  Ramp2_19
gaaccgttcccatcccactg

SEQ ID NO: 50941 - DNA, 20 bp, Artificial Sequence
  sgRNA
  Ramp2_20
gtagtcttccatcttccctg

SEQ ID NO: 50942 - DNA, 20 bp, Artificial Sequence
  sgRNA
  Ramp3_1
gcttcatcactggaatccac

SEQ ID NO: 50943 - DNA, 20 bp, Artificial Sequence
  sgRNA
  Ramp3_2
gagatggagaccaacatcat

SEQ ID NO: 50944 - DNA, 20 bp, Artificial Sequence
  sgRNA
  Ramp3_3
cttctgcatcatgtcagcga

SEQ ID NO: 50945 - DNA, 20 bp, Artificial Sequence
  sgRNA
  Ramp3_4
ctggaagtggtgcaacctgt

SEQ ID NO: 50946 - DNA, 20 bp, Artificial Sequence
  sgRNA
  Ramp3_5
tatgcggctgcaacgagaca

SEQ ID NO: 50947 - DNA, 20 bp, Artificial Sequence
  sgRNA
  Ramp3_6
ggcgcagcaagcacactgat

SEQ ID NO: 50948 - DNA, 20 bp, Artificial Sequence
  sgRNA
  Ramp3_7
atagccacagtcagcacgac

SEQ ID NO: 50949 - DNA, 20 bp, Artificial Sequence
  sgRNA
  Ramp3_8
gcttgctgcgccacaccacc

SEQ ID NO: 50950 - DNA, 20 bp, Artificial Sequence
  sgRNA
  Ramp3_9
agtactcatcccactgatcg

SEQ ID NO: 50951 - DNA, 20 bp, Artificial Sequence
  sgRNA
  Ramp3_10
gggatgagtacttcatccgg

SEQ ID NO: 50952 - DNA, 20 bp, Artificial Sequence
  sgRNA
  Ramp3_11
cgacaggaaccgcgatcagt

SEQ ID NO: 50953 - DNA, 20 bp, Artificial Sequence
  sgRNA
  Ramp3_12
ggatgagtacttcatccggg

SEQ ID NO: 50954 - DNA, 20 bp, Artificial Sequence
  sgRNA
  Ramp3_13
tgggatgagtacttcatccg

SEQ ID NO: 50955 - DNA, 20 bp, Artificial Sequence
  sgRNA
  Ramp3_14
ggtgagtgtgcccaggtatg

SEQ ID NO: 50956 - DNA, 20 bp, Artificial Sequence
  sgRNA
  Ramp3_15
tgatgaagctctgggccagc

SEQ ID NO: 50957 - DNA, 20 bp, Artificial Sequence
  sgRNA
  Ramp3_16
gacccactgggaagaccccc

SEQ ID NO: 50958 - DNA, 20 bp, Artificial Sequence
  sgRNA
  Ramp3_17
agttggaaaagaactgcctg

SEQ ID NO: 50959 - DNA, 20 bp, Artificial Sequence
  sgRNA
  Ramp3_18
gcgaaggctttcccacagcg

SEQ ID NO: 50960 - DNA, 20 bp, Artificial Sequence
  sgRNA
  Ramp3_19
cttcactaactgcaccgaga

SEQ ID NO: 50961 - DNA, 20 bp, Artificial Sequence
  sgRNA
  Ramp3_20
ctcgttgcagccgcatacct

SEQ ID NO: 50962 - DNA, 20 bp, Artificial Sequence
  sgRNA
  Reck_1
caatagtaaaggatgttccg

SEQ ID NO: 50963 - DNA, 20 bp, Artificial Sequence
  sgRNA
  Reck_2
agtgcaatttggccccgtcg

SEQ ID NO: 50964 - DNA, 20 bp, Artificial Sequence
  sgRNA
  Reck_3
ctgacttcatcgtccgccag

SEQ ID NO: 50965 - DNA, 20 bp, Artificial Sequence
  sgRNA
  Reck_4
ttactgaggtacgtgtccag

SEQ ID NO: 50966 - DNA, 20 bp, Artificial Sequence
  sgRNA
  Reck_5
catctgtgagtataatccgg

SEQ ID NO: 50967 - DNA, 20 bp, Artificial Sequence
  sgRNA
  Reck_6
agaagtagcagcgcgctgcg

SEQ ID NO: 50968 - DNA, 20 bp, Artificial Sequence
  sgRNA
  Reck_7
tctagtccagagcaagtgca

SEQ ID NO: 50969 - DNA, 20 bp, Artificial Sequence
  sgRNA
  Reck_8
gctgctacttctgctggccg

SEQ ID NO: 50970 - DNA, 20 bp, Artificial Sequence
  sgRNA
  Reck_9
gctttgatctgagatggccc

SEQ ID NO: 50971 - DNA, 20 bp, Artificial Sequence
  sgRNA
  Reck_10
tccctcaactggcctcgacg

SEQ ID NO: 50972 - DNA, 20 bp, Artificial Sequence
  sgRNA
  Reck_11
tctgcaacagatgtttcagt

SEQ ID NO: 50973 - DNA, 20 bp, Artificial Sequence
  sgRNA
  Reck_12
tatccaaacacgtcacactg

SEQ ID NO: 50974 - DNA, 20 bp, Artificial Sequence
  sgRNA
  Reck_13
tctgcactctgtaccaaaga

SEQ ID NO: 50975 - DNA, 20 bp, Artificial Sequence
  sgRNA
  Reck_14
ctactcagatcgtgtggccg

SEQ ID NO: 50976 - DNA, 20 bp, Artificial Sequence
  sgRNA
  Reck_15
ggggtatttaagaagtccga

SEQ ID NO: 50977 - DNA, 20 bp, Artificial Sequence
  sgRNA
  Reck_16
gccagagatgtggaaggccg

SEQ ID NO: 50978 - DNA, 20 bp, Artificial Sequence
  sgRNA
  Reck_17
gtcagcatggacacttccac

SEQ ID NO: 50979 - DNA, 20 bp, Artificial Sequence
  sgRNA
  Reck_18
gcacggctcagtctgaccag

SEQ ID NO: 50980 - DNA, 20 bp, Artificial Sequence
  sgRNA
  Reck_19
cttctgaagaatctccacaa

SEQ ID NO: 50981 - DNA, 20 bp, Artificial Sequence
  sgRNA
  Reck_20
ggattactacgggccctgcc

SEQ ID NO: 50982 - DNA, 20 bp, Artificial Sequence
  sgRNA
  Rell1_1
ctgctcgggagtgtaacgtg

SEQ ID NO: 50983 - DNA, 20 bp, Artificial Sequence
  sgRNA
  Rell1_2
tcttaagtaagtgacagatg

SEQ ID NO: 50984 - DNA, 20 bp, Artificial Sequence
  sgRNA
  Rell1_3
aatgagaacagtgacacggt

SEQ ID NO: 50985 - DNA, 20 bp, Artificial Sequence
  sgRNA
  Rell1_4
ctaccggtgtacaacagagg

SEQ ID NO: 50986 - DNA, 20 bp, Artificial Sequence
  sgRNA
  Rell1_5
gctgcttcagtgttcgtggg

SEQ ID NO: 50987 - DNA, 20 bp, Artificial Sequence
  sgRNA
  Rell1_6
ctgtcactcctagcacgcca

SEQ ID NO: 50988 - DNA, 20 bp, Artificial Sequence
  sgRNA
  Rell1_7
gttccgcctctgttgtacac

SEQ ID NO: 50989 - DNA, 20 bp, Artificial Sequence
  sgRNA
  Rell1_8
tgtcaccaggggccacccca

SEQ ID NO: 50990 - DNA, 20 bp, Artificial Sequence
  sgRNA
  Rell1_9
tggtcatcatctgcacacag

SEQ ID NO: 50991 - DNA, 20 bp, Artificial Sequence
  sgRNA
  Rell1_10
agacccatgacgaagaacac

SEQ ID NO: 50992 - DNA, 20 bp, Artificial Sequence
  sgRNA
  Rell1_11
tatggtagctgataacagcg

SEQ ID NO: 50993 - DNA, 20 bp, Artificial Sequence
  sgRNA
  Rell1_12
ggagcacaagtcaaatcaga

SEQ ID NO: 50994 - DNA, 20 bp, Artificial Sequence
  sgRNA
  Rell1_13
agcgatgcaggcacaagcga

SEQ ID NO: 50995 - DNA, 20 bp, Artificial Sequence
  sgRNA
  Rell1_14
catcatctgcacacagtggg

SEQ ID NO: 50996 - DNA, 20 bp, Artificial Sequence
  sgRNA
  Rell1_15
attccgggtgtccattccca

SEQ ID NO: 50997 - DNA, 20 bp, Artificial Sequence
  sgRNA
  Rell1_16
gtgacctcgccttgtcgccg

SEQ ID NO: 50998 - DNA, 20 bp, Artificial Sequence
  sgRNA
  Rell1_17
ctggcgtgctaggagtgaca

SEQ ID NO: 50999 - DNA, 20 bp, Artificial Sequence
  sgRNA
  Rell1_18
aggctaccggtgtacaacag

SEQ ID NO: 51000 - DNA, 20 bp, Artificial Sequence
  sgRNA
  Rell1_19
ggcggaacaggaagtcgaag

SEQ ID NO: 51001 - DNA, 20 bp, Artificial Sequence
  sgRNA
  Rell1_20
agaccaaagagggacggcca

SEQ ID NO: 51002 - DNA, 20 bp, Artificial Sequence
  sgRNA
  Relt_1
gcatggataggagttccatg

SEQ ID NO: 51003 - DNA, 20 bp, Artificial Sequence
  sgRNA
  Relt_2
gcaactcatgatacaatgtg

SEQ ID NO: 51004 - DNA, 20 bp, Artificial Sequence
  sgRNA
  Relt_3
ctataggcaggattaatccc

SEQ ID NO: 51005 - DNA, 20 bp, Artificial Sequence
  sgRNA
  Relt_4
agctggtacagacaagtcac

SEQ ID NO: 51006 - DNA, 20 bp, Artificial Sequence
  sgRNA
  Relt_5
gcagcaggtaccagtagcaa

SEQ ID NO: 51007 - DNA, 20 bp, Artificial Sequence
  sgRNA
  Relt_6
tgaggtgaagaccatcacgg

SEQ ID NO: 51008 - DNA, 20 bp, Artificial Sequence
  sgRNA
  Relt_7
ttgtagccagaagtggccag

SEQ ID NO: 51009 - DNA, 20 bp, Artificial Sequence
  sgRNA
  Relt_8
gctcaggaatacgagccaca

SEQ ID NO: 51010 - DNA, 20 bp, Artificial Sequence
  sgRNA
  Relt_9
gttggcatcttcagtcctat

SEQ ID NO: 51011 - DNA, 20 bp, Artificial Sequence
  sgRNA
  Relt_10
gtggctgtgatgagtcaggg

SEQ ID NO: 51012 - DNA, 20 bp, Artificial Sequence
  sgRNA
  Relt_11
gcatcttcagtcctataggc

SEQ ID NO: 51013 - DNA, 20 bp, Artificial Sequence
  sgRNA
  Relt_12
cccagcagagaacaaagctg

SEQ ID NO: 51014 - DNA, 20 bp, Artificial Sequence
  sgRNA
  Relt_13
gtggtgggagccatactaag

SEQ ID NO: 51015 - DNA, 20 bp, Artificial Sequence
  sgRNA
  Relt_14
tggctcgtattcctgagcag

SEQ ID NO: 51016 - DNA, 20 bp, Artificial Sequence
  sgRNA
  Relt_15
accgatgcagccttcaaaag

SEQ ID NO: 51017 - DNA, 20 bp, Artificial Sequence
  sgRNA
  Relt_16
cacttagccggaccacatag

SEQ ID NO: 51018 - DNA, 20 bp, Artificial Sequence
  sgRNA
  Relt_17
agccccatgagacaaaagac

SEQ ID NO: 51019 - DNA, 20 bp, Artificial Sequence
  sgRNA
  Relt_18
tgaaggctgcatcggtaatg

SEQ ID NO: 51020 - DNA, 20 bp, Artificial Sequence
  sgRNA
  Relt_19
gatgcagtaggcagaagggt

SEQ ID NO: 51021 - DNA, 20 bp, Artificial Sequence
  sgRNA
  Relt_20
gcacagcccaaaaggaagtt

SEQ ID NO: 51022 - DNA, 20 bp, Artificial Sequence
  sgRNA
  Ret_1
cggcacagcgcatcacacag

SEQ ID NO: 51023 - DNA, 20 bp, Artificial Sequence
  sgRNA
  Ret_2
atttacaaatagggtccccg

SEQ ID NO: 51024 - DNA, 20 bp, Artificial Sequence
  sgRNA
  Ret_3
cgtcaccctgaacctaccca

SEQ ID NO: 51025 - DNA, 20 bp, Artificial Sequence
  sgRNA
  Ret_4
tctatggcgtctaccgtaca

SEQ ID NO: 51026 - DNA, 20 bp, Artificial Sequence
  sgRNA
  Ret_5
ggcccagcagaccttccggg

SEQ ID NO: 51027 - DNA, 20 bp, Artificial Sequence
  sgRNA
  Ret_6
gtaccactcacgagagccga

SEQ ID NO: 51028 - DNA, 20 bp, Artificial Sequence
  sgRNA
  Ret_7
atctgcatcgaacacctgca

SEQ ID NO: 51029 - DNA, 20 bp, Artificial Sequence
  sgRNA
  Ret_8
cgatgggcgaatgctccacc

SEQ ID NO: 51030 - DNA, 20 bp, Artificial Sequence
  sgRNA
  Ret_9
gtcacggaggaatccccgca

SEQ ID NO: 51031 - DNA, 20 bp, Artificial Sequence
  sgRNA
  Ret_10
ggtgcactcaggtcgccgca

SEQ ID NO: 51032 - DNA, 20 bp, Artificial Sequence
  sgRNA
  Ret_11
agtcctgtgcagtaaacaag

SEQ ID NO: 51033 - DNA, 20 bp, Artificial Sequence
  sgRNA
  Ret_12
agaagtgccgagcttccgcc

SEQ ID NO: 51034 - DNA, 20 bp, Artificial Sequence
  sgRNA
  Ret_13
gtcgttcaggaggaattcca

SEQ ID NO: 51035 - DNA, 20 bp, Artificial Sequence
  sgRNA
  Ret_14
atttccgctgatgcaatggg

SEQ ID NO: 51036 - DNA, 20 bp, Artificial Sequence
  sgRNA
  Ret_15
gctgcctccaccgctcacat

SEQ ID NO: 51037 - DNA, 20 bp, Artificial Sequence
  sgRNA
  Ret_16
ggctctccacagcatcacag

SEQ ID NO: 51038 - DNA, 20 bp, Artificial Sequence
  sgRNA
  Ret_17
caccaagcttcagtacacgg

SEQ ID NO: 51039 - DNA, 20 bp, Artificial Sequence
  sgRNA
  Ret_18
aggtcaacaacaactccgtt

SEQ ID NO: 51040 - DNA, 20 bp, Artificial Sequence
  sgRNA
  Ret_19
tcatacagcagtgagtccga

SEQ ID NO: 51041 - DNA, 20 bp, Artificial Sequence
  sgRNA
  Ret_20
gcagacccgcagacagaccc

SEQ ID NO: 51042 - DNA, 20 bp, Artificial Sequence
  sgRNA
  Rgma_1
accatcgtggtgcgacaggt

SEQ ID NO: 51043 - DNA, 20 bp, Artificial Sequence
  sgRNA
  Rgma_2
acagaactccggcacgtcgt

SEQ ID NO: 51044 - DNA, 20 bp, Artificial Sequence
  sgRNA
  Rgma_3
gagggtcggccacaatccca

SEQ ID NO: 51045 - DNA, 20 bp, Artificial Sequence
  sgRNA
  Rgma_4
aggtaattattgtcgatgag

SEQ ID NO: 51046 - DNA, 20 bp, Artificial Sequence
  sgRNA
  Rgma_5
ctatgccatggacagccgag

SEQ ID NO: 51047 - DNA, 20 bp, Artificial Sequence
  sgRNA
  Rgma_6
gcacagggcgtaggtgcgca

SEQ ID NO: 51048 - DNA, 20 bp, Artificial Sequence
  sgRNA
  Rgma_7
tacctcctcgggcatccgga

SEQ ID NO: 51049 - DNA, 20 bp, Artificial Sequence
  sgRNA
  Rgma_8
gggcgacctggcttaccact

SEQ ID NO: 51050 - DNA, 20 bp, Artificial Sequence
  sgRNA
  Rgma_9
tcacatcaccagtcgtgagg

SEQ ID NO: 51051 - DNA, 20 bp, Artificial Sequence
  sgRNA
  Rgma_10
ggaggtagtcaacgccgtgg

SEQ ID NO: 51052 - DNA, 20 bp, Artificial Sequence
  sgRNA
  Rgma_11
gcccacctgtcgcaccacga

SEQ ID NO: 51053 - DNA, 20 bp, Artificial Sequence
  sgRNA
  Rgma_12
gctacctgacctttgccgtc

SEQ ID NO: 51054 - DNA, 20 bp, Artificial Sequence
  sgRNA
  Rgma_13
gcggacggctccaaaaatgg

SEQ ID NO: 51055 - DNA, 20 bp, Artificial Sequence
  sgRNA
  Rgma_14
gagccagcacaactgctcca

SEQ ID NO: 51056 - DNA, 20 bp, Artificial Sequence
  sgRNA
  Rgma_15
agttcacatcaccagtcgtg

SEQ ID NO: 51057 - DNA, 20 bp, Artificial Sequence
  sgRNA
  Rgma_16
cctacgccctgtgcactcgg

SEQ ID NO: 51058 - DNA, 20 bp, Artificial Sequence
  sgRNA
  Rgma_17
ctttgccgtccggatgcccg

SEQ ID NO: 51059 - DNA, 20 bp, Artificial Sequence
  sgRNA
  Rgma_18
cttccgtctgcctttgcgga

SEQ ID NO: 51060 - DNA, 20 bp, Artificial Sequence
  sgRNA
  Rgma_19
tggtgatgtgaacttcacgc

SEQ ID NO: 51061 - DNA, 20 bp, Artificial Sequence
  sgRNA
  Rgma_20
gcttaccactcggctgtcca

SEQ ID NO: 51062 - DNA, 20 bp, Artificial Sequence
  sgRNA
  Rgmb_1
cgtgaagagtcttcacatcg

SEQ ID NO: 51063 - DNA, 20 bp, Artificial Sequence
  sgRNA
  Rgmb_2
cgttcgtcacttgaaccgaa

SEQ ID NO: 51064 - DNA, 20 bp, Artificial Sequence
  sgRNA
  Rgmb_3
agtgatccttgaaagttcga

SEQ ID NO: 51065 - DNA, 20 bp, Artificial Sequence
  sgRNA
  Rgmb_4
ctcagagtcaaacccatcag

SEQ ID NO: 51066 - DNA, 20 bp, Artificial Sequence
  sgRNA
  Rgmb_5
gcaggtcgaagacacacgat

SEQ ID NO: 51067 - DNA, 20 bp, Artificial Sequence
  sgRNA
  Rgmb_6
gcacgagtgcacggatcaga

SEQ ID NO: 51068 - DNA, 20 bp, Artificial Sequence
  sgRNA
  Rgmb_7
cgaacttcaaaggcctgccg

SEQ ID NO: 51069 - DNA, 20 bp, Artificial Sequence
  sgRNA
  Rgmb_8
catgttctctgactcccccg

SEQ ID NO: 51070 - DNA, 20 bp, Artificial Sequence
  sgRNA
  Rgmb_9
cagctgtcgcacaaacactg

SEQ ID NO: 51071 - DNA, 20 bp, Artificial Sequence
  sgRNA
  Rgmb_10
gggcatgcatctctacgtag

SEQ ID NO: 51072 - DNA, 20 bp, Artificial Sequence
  sgRNA
  Rgmb_11
aatggtacaccaggttgcct

SEQ ID NO: 51073 - DNA, 20 bp, Artificial Sequence
  sgRNA
  Rgmb_12
tgtaactaccacagccacgg

SEQ ID NO: 51074 - DNA, 20 bp, Artificial Sequence
  sgRNA
  Rgmb_13
gcaggcctttgaagttcgct

SEQ ID NO: 51075 - DNA, 20 bp, Artificial Sequence
  sgRNA
  Rgmb_14
ttcgggcatccggatagcga

SEQ ID NO: 51076 - DNA, 20 bp, Artificial Sequence
  sgRNA
  Rgmb_15
catagacaacaattaccttt

SEQ ID NO: 51077 - DNA, 20 bp, Artificial Sequence
  sgRNA
  Rgmb_16
gcatccggatagcgagggtt

SEQ ID NO: 51078 - DNA, 20 bp, Artificial Sequence
  sgRNA
  Rgmb_17
acccacatcttccaccaatc

SEQ ID NO: 51079 - DNA, 20 bp, Artificial Sequence
  sgRNA
  Rgmb_18
ccttgaaagttcgaaggtga

SEQ ID NO: 51080 - DNA, 20 bp, Artificial Sequence
  sgRNA
  Rgmb_19
tgcacccaagaaaggaacgc

SEQ ID NO: 51081 - DNA, 20 bp, Artificial Sequence
  sgRNA
  Rgmb_20
tagcagttgcactggacccg

SEQ ID NO: 51082 - DNA, 20 bp, Artificial Sequence
  sgRNA
  Rgr_1
tggcagccctctgaaccatg

SEQ ID NO: 51083 - DNA, 20 bp, Artificial Sequence
  sgRNA
  Rgr_2
tgtacactggactattcgag

SEQ ID NO: 51084 - DNA, 20 bp, Artificial Sequence
  sgRNA
  Rgr_3
tgcaggcagacagttggcat

SEQ ID NO: 51085 - DNA, 20 bp, Artificial Sequence
  sgRNA
  Rgr_4
gtgtgatgaacaggggtacg

SEQ ID NO: 51086 - DNA, 20 bp, Artificial Sequence
  sgRNA
  Rgr_5
catcaactatgcgttgcaca

SEQ ID NO: 51087 - DNA, 20 bp, Artificial Sequence
  sgRNA
  Rgr_6
gggccaggctcagtaccagc

SEQ ID NO: 51088 - DNA, 20 bp, Artificial Sequence
  sgRNA
  Rgr_7
gtagtggtgataacgtcccc

SEQ ID NO: 51089 - DNA, 20 bp, Artificial Sequence
  sgRNA
  Rgr_8
tcaagttcccccaaaccagc

SEQ ID NO: 51090 - DNA, 20 bp, Artificial Sequence
  sgRNA
  Rgr_9
catctgcgatggctgcgtat

SEQ ID NO: 51091 - DNA, 20 bp, Artificial Sequence
  sgRNA
  Rgr_10
gtgataacgtccccaggcaa

SEQ ID NO: 51092 - DNA, 20 bp, Artificial Sequence
  sgRNA
  Rgr_11
tccacacaaacagcaccaga

SEQ ID NO: 51093 - DNA, 20 bp, Artificial Sequence
  sgRNA
  Rgr_12
gatgaagctcacatctgcga

SEQ ID NO: 51094 - DNA, 20 bp, Artificial Sequence
  sgRNA
  Rgr_13
gctggtactgagcctggccc

SEQ ID NO: 51095 - DNA, 20 bp, Artificial Sequence
  sgRNA
  Rgr_14
gcggactcccagcaacctgc

SEQ ID NO: 51096 - DNA, 20 bp, Artificial Sequence
  sgRNA
  Rgr_15
catctctcctaaactacaga

SEQ ID NO: 51097 - DNA, 20 bp, Artificial Sequence
  sgRNA
  Rgr_16
ctgtacactggactattcga

SEQ ID NO: 51098 - DNA, 20 bp, Artificial Sequence
  sgRNA
  Rgr_17
gctggataccgctgcaacaa

SEQ ID NO: 51099 - DNA, 20 bp, Artificial Sequence
  sgRNA
  Rgr_18
gctgatcccagtgtctgcca

SEQ ID NO: 51100 - DNA, 20 bp, Artificial Sequence
  sgRNA
  Rgr_19
ggctgcgtataggtacagga

SEQ ID NO: 51101 - DNA, 20 bp, Artificial Sequence
  sgRNA
  Rgr_20
gtataggtacaggagggcat

SEQ ID NO: 51102 - DNA, 20 bp, Artificial Sequence
  sgRNA
  Rhag_1
cctgcataatcgtaccccat

SEQ ID NO: 51103 - DNA, 20 bp, Artificial Sequence
  sgRNA
  Rhag_2
gcaatggctgaattaaagct

SEQ ID NO: 51104 - DNA, 20 bp, Artificial Sequence
  sgRNA
  Rhag_3
ggcataggctgtgatcacac

SEQ ID NO: 51105 - DNA, 20 bp, Artificial Sequence
  sgRNA
  Rhag_4
tcatgatcaacatttgaatg

SEQ ID NO: 51106 - DNA, 20 bp, Artificial Sequence
  sgRNA
  Rhag_5
tgaccattggaagcattgca

SEQ ID NO: 51107 - DNA, 20 bp, Artificial Sequence
  sgRNA
  Rhag_6
gcataatcgtaccccattgg

SEQ ID NO: 51108 - DNA, 20 bp, Artificial Sequence
  sgRNA
  Rhag_7
acatgcaaatcacaaccacg

SEQ ID NO: 51109 - DNA, 20 bp, Artificial Sequence
  sgRNA
  Rhag_8
gatgatccatgatacatgtg

SEQ ID NO: 51110 - DNA, 20 bp, Artificial Sequence
  sgRNA
  Rhag_9
gcctgcctcggcgctctaca

SEQ ID NO: 51111 - DNA, 20 bp, Artificial Sequence
  sgRNA
  Rhag_10
caatggggtacgattatgca

SEQ ID NO: 51112 - DNA, 20 bp, Artificial Sequence
  sgRNA
  Rhag_11
cacggaaaggaatttcactt

SEQ ID NO: 51113 - DNA, 20 bp, Artificial Sequence
  sgRNA
  Rhag_12
tcatggcaaacaagtcagag

SEQ ID NO: 51114 - DNA, 20 bp, Artificial Sequence
  sgRNA
  Rhag_13
tggtcatagcagcatatagg

SEQ ID NO: 51115 - DNA, 20 bp, Artificial Sequence
  sgRNA
  Rhag_14
tcaggtggctggttccagat

SEQ ID NO: 51116 - DNA, 20 bp, Artificial Sequence
  sgRNA
  Rhag_15
gcaaggcctccaaaaactcc

SEQ ID NO: 51117 - DNA, 20 bp, Artificial Sequence
  sgRNA
  Rhag_16
gcaggtgtgttatatcggcc

SEQ ID NO: 51118 - DNA, 20 bp, Artificial Sequence
  sgRNA
  Rhag_17
cgaagtgaaattcctttccg

SEQ ID NO: 51119 - DNA, 20 bp, Artificial Sequence
  sgRNA
  Rhag_18
atgatctccaggatcagcaa

SEQ ID NO: 51120 - DNA, 20 bp, Artificial Sequence
  sgRNA
  Rhag_19
gcagcactgggatcttccat

SEQ ID NO: 51121 - DNA, 20 bp, Artificial Sequence
  sgRNA
  Rhag_20
gctgctctgggcctccaatg

SEQ ID NO: 51122 - DNA, 20 bp, Artificial Sequence
  sgRNA
  Rhbdf2_1
acagatatcctcttgcggcg

SEQ ID NO: 51123 - DNA, 20 bp, Artificial Sequence
  sgRNA
  Rhbdf2_2
gtgaacgaacgtcagccagt

SEQ ID NO: 51124 - DNA, 20 bp, Artificial Sequence
  sgRNA
  Rhbdf2_3
taaagtggcagaatgatact

SEQ ID NO: 51125 - DNA, 20 bp, Artificial Sequence
  sgRNA
  Rhbdf2_4
accagaaaagaatacagcgg

SEQ ID NO: 51126 - DNA, 20 bp, Artificial Sequence
  sgRNA
  Rhbdf2_5
ggcctgatgacattaccaag

SEQ ID NO: 51127 - DNA, 20 bp, Artificial Sequence
  sgRNA
  Rhbdf2_6
ctatgtgcaacaagcccgtg

SEQ ID NO: 51128 - DNA, 20 bp, Artificial Sequence
  sgRNA
  Rhbdf2_7
tgatgctgcgtcgatagctt

SEQ ID NO: 51129 - DNA, 20 bp, Artificial Sequence
  sgRNA
  Rhbdf2_8
gcatgctatcctgctcgccg

SEQ ID NO: 51130 - DNA, 20 bp, Artificial Sequence
  sgRNA
  Rhbdf2_9
gagtactgtgagttcatgca

SEQ ID NO: 51131 - DNA, 20 bp, Artificial Sequence
  sgRNA
  Rhbdf2_10
gcatcagcagcaccgtgcag

SEQ ID NO: 51132 - DNA, 20 bp, Artificial Sequence
  sgRNA
  Rhbdf2_11
gttctcgccctgcatccgga

SEQ ID NO: 51133 - DNA, 20 bp, Artificial Sequence
  sgRNA
  Rhbdf2_12
gtcagcctacaggagccccg

SEQ ID NO: 51134 - DNA, 20 bp, Artificial Sequence
  sgRNA
  Rhbdf2_13
cctgagccagaagcagccat

SEQ ID NO: 51135 - DNA, 20 bp, Artificial Sequence
  sgRNA
  Rhbdf2_14
ggaaaagcacaatggccgac

SEQ ID NO: 51136 - DNA, 20 bp, Artificial Sequence
  sgRNA
  Rhbdf2_15
aattgagcagctggtacgga

SEQ ID NO: 51137 - DNA, 20 bp, Artificial Sequence
  sgRNA
  Rhbdf2_16
gttccgtgctagatgcgact

SEQ ID NO: 51138 - DNA, 20 bp, Artificial Sequence
  sgRNA
  Rhbdf2_17
tgggcgatgttgtctatcca

SEQ ID NO: 51139 - DNA, 20 bp, Artificial Sequence
  sgRNA
  Rhbdf2_18
gaactcacagtactcccgag

SEQ ID NO: 51140 - DNA, 20 bp, Artificial Sequence
  sgRNA
  Rhbdf2_19
gctccacgaagaggcaggcg

SEQ ID NO: 51141 - DNA, 20 bp, Artificial Sequence
  sgRNA
  Rhbdf2_20
ctgtgtccagaatgaccgct

SEQ ID NO: 51142 - DNA, 20 bp, Artificial Sequence
  sgRNA
  Rhbdl2_1
gctcccacaagagacttgag

SEQ ID NO: 51143 - DNA, 20 bp, Artificial Sequence
  sgRNA
  Rhbdl2_2
ggtccacaaaggcctccgag

SEQ ID NO: 51144 - DNA, 20 bp, Artificial Sequence
  sgRNA
  Rhbdl2_3
ttctcagggcagtacgtcaa

SEQ ID NO: 51145 - DNA, 20 bp, Artificial Sequence
  sgRNA
  Rhbdl2_4
agagggaaaggaagaaccgg

SEQ ID NO: 51146 - DNA, 20 bp, Artificial Sequence
  sgRNA
  Rhbdl2_5
agaccctgctcaaagacccc

SEQ ID NO: 51147 - DNA, 20 bp, Artificial Sequence
  sgRNA
  Rhbdl2_6
ggtacaccagccccactcgg

SEQ ID NO: 51148 - DNA, 20 bp, Artificial Sequence
  sgRNA
  Rhbdl2_7
ccaggagcagaaaggtccac

SEQ ID NO: 51149 - DNA, 20 bp, Artificial Sequence
  sgRNA
  Rhbdl2_8
gtactgccctgagaagaggg

SEQ ID NO: 51150 - DNA, 20 bp, Artificial Sequence
  sgRNA
  Rhbdl2_9
ccaggtacaccagccccact

SEQ ID NO: 51151 - DNA, 20 bp, Artificial Sequence
  sgRNA
  Rhbdl2_10
atgtgagcagcaaaggacac

SEQ ID NO: 51152 - DNA, 20 bp, Artificial Sequence
  sgRNA
  Rhbdl2_11
ttccaagatccccgtgtcca

SEQ ID NO: 51153 - DNA, 20 bp, Artificial Sequence
  sgRNA
  Rhbdl2_12
acagaagcagtggatcaccc

SEQ ID NO: 51154 - DNA, 20 bp, Artificial Sequence
  sgRNA
  Rhbdl2_13
gagaaggtaaagacttcccc

SEQ ID NO: 51155 - DNA, 20 bp, Artificial Sequence
  sgRNA
  Rhbdl2_14
aggcttcctccctcttctca

SEQ ID NO: 51156 - DNA, 20 bp, Artificial Sequence
  sgRNA
  Rhbdl2_15
agtctgacgattccaaaggc

SEQ ID NO: 51157 - DNA, 20 bp, Artificial Sequence
  sgRNA
  Rhbdl2_16
gagtagtctgacgattccaa

SEQ ID NO: 51158 - DNA, 20 bp, Artificial Sequence
  sgRNA
  Rhbdl2_17
catgtatgagataaacctcc

SEQ ID NO: 51159 - DNA, 20 bp, Artificial Sequence
  sgRNA
  Rhbdl2_18
tccacaggatcgtctccaag

SEQ ID NO: 51160 - DNA, 20 bp, Artificial Sequence
  sgRNA
  Rhbdl2_19
cgatgtgctggactccggca

SEQ ID NO: 51161 - DNA, 20 bp, Artificial Sequence
  sgRNA
  Rhbdl2_20
tgacgtactgccctgagaag

SEQ ID NO: 51162 - DNA, 20 bp, Artificial Sequence
  sgRNA
  Rhcg_1
cttacggcgctctcatcgtg

SEQ ID NO: 51163 - DNA, 20 bp, Artificial Sequence
  sgRNA
  Rhcg_2
tcactgtaaagagagtcact

SEQ ID NO: 51164 - DNA, 20 bp, Artificial Sequence
  sgRNA
  Rhcg_3
tccagtattgtacacaagaa

SEQ ID NO: 51165 - DNA, 20 bp, Artificial Sequence
  sgRNA
  Rhcg_4
caaagtaggcgccaaatgtg

SEQ ID NO: 51166 - DNA, 20 bp, Artificial Sequence
  sgRNA
  Rhcg_5
tcatggcgaaaaggtccgag

SEQ ID NO: 51167 - DNA, 20 bp, Artificial Sequence
  sgRNA
  Rhcg_6
ggaacaccaaccttcggggg

SEQ ID NO: 51168 - DNA, 20 bp, Artificial Sequence
  sgRNA
  Rhcg_7
ggatgccgaaagctgccagc

SEQ ID NO: 51169 - DNA, 20 bp, Artificial Sequence
  sgRNA
  Rhcg_8
gatcctctaccgaaaaaacc

SEQ ID NO: 51170 - DNA, 20 bp, Artificial Sequence
  sgRNA
  Rhcg_9
gcacactcgctgccaaggag

SEQ ID NO: 51171 - DNA, 20 bp, Artificial Sequence
  sgRNA
  Rhcg_10
gaacactgtctacattcccg

SEQ ID NO: 51172 - DNA, 20 bp, Artificial Sequence
  sgRNA
  Rhcg_11
catcctcctgaacctgatag

SEQ ID NO: 51173 - DNA, 20 bp, Artificial Sequence
  sgRNA
  Rhcg_12
tgtaggcttcaacttcctgc

SEQ ID NO: 51174 - DNA, 20 bp, Artificial Sequence
  sgRNA
  Rhcg_13
ggtcacttgcaggatcaggc

SEQ ID NO: 51175 - DNA, 20 bp, Artificial Sequence
  sgRNA
  Rhcg_14
gagatgatgctcacacctta

SEQ ID NO: 51176 - DNA, 20 bp, Artificial Sequence
  sgRNA
  Rhcg_15
cgttaggtatgcaaatccta

SEQ ID NO: 51177 - DNA, 20 bp, Artificial Sequence
  sgRNA
  Rhcg_16
gccgaagcccacgaagacca

SEQ ID NO: 51178 - DNA, 20 bp, Artificial Sequence
  sgRNA
  Rhcg_17
aggatactggaggtgtcgga

SEQ ID NO: 51179 - DNA, 20 bp, Artificial Sequence
  sgRNA
  Rhcg_18
ggtcactgtgagcccaaagt

SEQ ID NO: 51180 - DNA, 20 bp, Artificial Sequence
  sgRNA
  Rhcg_19
agaatgccacgcttgcaggt

SEQ ID NO: 51181 - DNA, 20 bp, Artificial Sequence
  sgRNA
  Rhcg_20
ctgatgtgtatggagagcca

SEQ ID NO: 51182 - DNA, 20 bp, Artificial Sequence
  sgRNA
  Rho_1
tctgctcatacctccaagtg

SEQ ID NO: 51183 - DNA, 20 bp, Artificial Sequence
  sgRNA
  Rho_2
agccatggagtgatgtgtag

SEQ ID NO: 51184 - DNA, 20 bp, Artificial Sequence
  sgRNA
  Rho_3
gtacggtgacgtagagcgtg

SEQ ID NO: 51185 - DNA, 20 bp, Artificial Sequence
  sgRNA
  Rho_4
cctggaccagccaacgagtg

SEQ ID NO: 51186 - DNA, 20 bp, Artificial Sequence
  sgRNA
  Rho_5
ggttccgccaggtagtactg

SEQ ID NO: 51187 - DNA, 20 bp, Artificial Sequence
  sgRNA
  Rho_6
agaactgccatggttccgcc

SEQ ID NO: 51188 - DNA, 20 bp, Artificial Sequence
  sgRNA
  Rho_7
catcctgctcaacttggccg

SEQ ID NO: 51189 - DNA, 20 bp, Artificial Sequence
  sgRNA
  Rho_8
ggacacctagacaggctatg

SEQ ID NO: 51190 - DNA, 20 bp, Artificial Sequence
  sgRNA
  Rho_9
tgctgcggcaagaatccact

SEQ ID NO: 51191 - DNA, 20 bp, Artificial Sequence
  sgRNA
  Rho_10
tagaaggccacactggcgta

SEQ ID NO: 51192 - DNA, 20 bp, Artificial Sequence
  sgRNA
  Rho_11
tgaccatgatgataaccatg

SEQ ID NO: 51193 - DNA, 20 bp, Artificial Sequence
  sgRNA
  Rho_12
gagctcttccatctataacc

SEQ ID NO: 51194 - DNA, 20 bp, Artificial Sequence
  sgRNA
  Rho_13
atgctcaccacgctgtgctg

SEQ ID NO: 51195 - DNA, 20 bp, Artificial Sequence
  sgRNA
  Rho_14
cctggccattgagcgctacg

SEQ ID NO: 51196 - DNA, 20 bp, Artificial Sequence
  sgRNA
  Rho_15
gcagccgcagtactacctgg

SEQ ID NO: 51197 - DNA, 20 bp, Artificial Sequence
  sgRNA
  Rho_16
gaggcgtcgtcatctcccag

SEQ ID NO: 51198 - DNA, 20 bp, Artificial Sequence
  sgRNA
  Rho_17
acgcctgtgacgttggagaa

SEQ ID NO: 51199 - DNA, 20 bp, Artificial Sequence
  sgRNA
  Rho_18
gcgcagcttcttgtgctgta

SEQ ID NO: 51200 - DNA, 20 bp, Artificial Sequence
  sgRNA
  Rho_19
gctggtctccgtcttggaag

SEQ ID NO: 51201 - DNA, 20 bp, Artificial Sequence
  sgRNA
  Rho_20
gctggcagagtcatgaagat

SEQ ID NO: 51202 - DNA, 20 bp, Artificial Sequence
  sgRNA
  Rnf128_1
gcacaccggagtgaaccgca

SEQ ID NO: 51203 - DNA, 20 bp, Artificial Sequence
  sgRNA
  Rnf128_2
ataattacggcagcaaccgt

SEQ ID NO: 51204 - DNA, 20 bp, Artificial Sequence
  sgRNA
  Rnf128_3
ttggccctcatccaacgcgg

SEQ ID NO: 51205 - DNA, 20 bp, Artificial Sequence
  sgRNA
  Rnf128_4
tcacaatggtcatcgaagta

SEQ ID NO: 51206 - DNA, 20 bp, Artificial Sequence
  sgRNA
  Rnf128_5
cagtagaccccgatcccggg

SEQ ID NO: 51207 - DNA, 20 bp, Artificial Sequence
  sgRNA
  Rnf128_6
tggttggccctcatccaacg

SEQ ID NO: 51208 - DNA, 20 bp, Artificial Sequence
  sgRNA
  Rnf128_7
ccaggacacgttgaggtacg

SEQ ID NO: 51209 - DNA, 20 bp, Artificial Sequence
  sgRNA
  Rnf128_8
gggcaaccagacgatacaga

SEQ ID NO: 51210 - DNA, 20 bp, Artificial Sequence
  sgRNA
  Rnf128_9
ttgaataatgattcacccaa

SEQ ID NO: 51211 - DNA, 20 bp, Artificial Sequence
  sgRNA
  Rnf128_10
cgctcagctcccacaccgtg

SEQ ID NO: 51212 - DNA, 20 bp, Artificial Sequence
  sgRNA
  Rnf128_11
ttaccaacactgctaagcct

SEQ ID NO: 51213 - DNA, 20 bp, Artificial Sequence
  sgRNA
  Rnf128_12
ccacaccgtgcggttcactc

SEQ ID NO: 51214 - DNA, 20 bp, Artificial Sequence
  sgRNA
  Rnf128_13
cgtacctcaacgtgtcctgg

SEQ ID NO: 51215 - DNA, 20 bp, Artificial Sequence
  sgRNA
  Rnf128_14
gttgaggtacgcggtccaca

SEQ ID NO: 51216 - DNA, 20 bp, Artificial Sequence
  sgRNA
  Rnf128_15
atcggggtctactgccgcgg

SEQ ID NO: 51217 - DNA, 20 bp, Artificial Sequence
  sgRNA
  Rnf128_16
tggattgcgctgatagaaag

SEQ ID NO: 51218 - DNA, 20 bp, Artificial Sequence
  sgRNA
  Rnf128_17
tcacggtgcccacggtttgg

SEQ ID NO: 51219 - DNA, 20 bp, Artificial Sequence
  sgRNA
  Rnf128_18
tgacctcattgcgggtccca

SEQ ID NO: 51220 - DNA, 20 bp, Artificial Sequence
  sgRNA
  Rnf128_19
gttacaggcgttgagcgccc

SEQ ID NO: 51221 - DNA, 20 bp, Artificial Sequence
  sgRNA
  Rnf128_20
gtacgcggtccacacggctt

SEQ ID NO: 51222 - DNA, 20 bp, Artificial Sequence
  sgRNA
  Rnf13_1
ttgtaatcctgctcaccgtt

SEQ ID NO: 51223 - DNA, 20 bp, Artificial Sequence
  sgRNA
  Rnf13_2
gattcaccaataaagacaga

SEQ ID NO: 51224 - DNA, 20 bp, Artificial Sequence
  sgRNA
  Rnf13_3
gacagagtcttcagactacg

SEQ ID NO: 51225 - DNA, 20 bp, Artificial Sequence
  sgRNA
  Rnf13_4
aatcagcacgatgaacgtgc

SEQ ID NO: 51226 - DNA, 20 bp, Artificial Sequence
  sgRNA
  Rnf13_5
gctgcagccgaacggtgagc

SEQ ID NO: 51227 - DNA, 20 bp, Artificial Sequence
  sgRNA
  Rnf13_6
gcagctggaccacaacactg

SEQ ID NO: 51228 - DNA, 20 bp, Artificial Sequence
  sgRNA
  Rnf13_7
gggatcagatagtactccaa

SEQ ID NO: 51229 - DNA, 20 bp, Artificial Sequence
  sgRNA
  Rnf13_8
cccgtacataaatttaaaaa

SEQ ID NO: 51230 - DNA, 20 bp, Artificial Sequence
  sgRNA
  Rnf13_9
ggcagatgcccactatgatg

SEQ ID NO: 51231 - DNA, 20 bp, Artificial Sequence
  sgRNA
  Rnf13_10
tctgatgacctgattagcat

SEQ ID NO: 51232 - DNA, 20 bp, Artificial Sequence
  sgRNA
  Rnf13_11
tgaaaatgactattaagatg

SEQ ID NO: 51233 - DNA, 20 bp, Artificial Sequence
  sgRNA
  Rnf13_12
atgaagacggagataagcta

SEQ ID NO: 51234 - DNA, 20 bp, Artificial Sequence
  sgRNA
  Rnf13_13
gtggtccagctgcagccgaa

SEQ ID NO: 51235 - DNA, 20 bp, Artificial Sequence
  sgRNA
  Rnf13_14
gtactcataccatgggagca

SEQ ID NO: 51236 - DNA, 20 bp, Artificial Sequence
  sgRNA
  Rnf13_15
gtcctggcagaagctgaggg

SEQ ID NO: 51237 - DNA, 20 bp, Artificial Sequence
  sgRNA
  Rnf13_16
gatccccttcctcatcatag

SEQ ID NO: 51238 - DNA, 20 bp, Artificial Sequence
  sgRNA
  Rnf13_17
aattaccgaccacagtgttg

SEQ ID NO: 51239 - DNA, 20 bp, Artificial Sequence
  sgRNA
  Rnf13_18
tgtctggaggagtatgaaga

SEQ ID NO: 51240 - DNA, 20 bp, Artificial Sequence
  sgRNA
  Rnf13_19
attgcaagtgtgtagatccc

SEQ ID NO: 51241 - DNA, 20 bp, Artificial Sequence
  sgRNA
  Rnf13_20
ccactgaaagacaattcttc

SEQ ID NO: 51242 - DNA, 20 bp, Artificial Sequence
  sgRNA
  Rnf130_1
tggatcgccttgctacaaag

SEQ ID NO: 51243 - DNA, 20 bp, Artificial Sequence
  sgRNA
  Rnf130_2
ctcgcgttgtccgctcgcgt

SEQ ID NO: 51244 - DNA, 20 bp, Artificial Sequence
  sgRNA
  Rnf130_3
ccgccaaagaacttcagccg

SEQ ID NO: 51245 - DNA, 20 bp, Artificial Sequence
  sgRNA
  Rnf130_4
ctcacgttccgcatcgaccg

SEQ ID NO: 51246 - DNA, 20 bp, Artificial Sequence
  sgRNA
  Rnf130_5
gtcgatgcggaacgtgagcg

SEQ ID NO: 51247 - DNA, 20 bp, Artificial Sequence
  sgRNA
  Rnf130_6
acacgaagactagagagcca

SEQ ID NO: 51248 - DNA, 20 bp, Artificial Sequence
  sgRNA
  Rnf130_7
ctacgggctcgactcaccca

SEQ ID NO: 51249 - DNA, 20 bp, Artificial Sequence
  sgRNA
  Rnf130_8
tgatgattatttcttcagcg

SEQ ID NO: 51250 - DNA, 20 bp, Artificial Sequence
  sgRNA
  Rnf130_9
ggtcagcctttccatatcaa

SEQ ID NO: 51251 - DNA, 20 bp, Artificial Sequence
  sgRNA
  Rnf130_10
cgcgagccaggagtactaca

SEQ ID NO: 51252 - DNA, 20 bp, Artificial Sequence
  sgRNA
  Rnf130_11
gctcgactcacccaaggccg

SEQ ID NO: 51253 - DNA, 20 bp, Artificial Sequence
  sgRNA
  Rnf130_12
tccctcctaatatcaaacag

SEQ ID NO: 51254 - DNA, 20 bp, Artificial Sequence
  sgRNA
  Rnf130_13
gtacaaatgacaatagctgt

SEQ ID NO: 51255 - DNA, 20 bp, Artificial Sequence
  sgRNA
  Rnf130_14
tgggctgtgatcctcaaaca

SEQ ID NO: 51256 - DNA, 20 bp, Artificial Sequence
  sgRNA
  Rnf130_15
cacggcgctcatcaacgtga

SEQ ID NO: 51257 - DNA, 20 bp, Artificial Sequence
  sgRNA
  Rnf130_16
gtacagtgttcactgagcca

SEQ ID NO: 51258 - DNA, 20 bp, Artificial Sequence
  sgRNA
  Rnf130_17
tatcgcctcttcctcaagat

SEQ ID NO: 51259 - DNA, 20 bp, Artificial Sequence
  sgRNA
  Rnf130_18
atgttgatttcacccgtgcg

SEQ ID NO: 51260 - DNA, 20 bp, Artificial Sequence
  sgRNA
  Rnf130_19
ggagtgagctccccatcttg

SEQ ID NO: 51261 - DNA, 20 bp, Artificial Sequence
  sgRNA
  Rnf130_20
acaactagaacggtgaaaaa

SEQ ID NO: 51262 - DNA, 20 bp, Artificial Sequence
  sgRNA
  Rnf149_1
catggtgagcatcgaatacg

SEQ ID NO: 51263 - DNA, 20 bp, Artificial Sequence
  sgRNA
  Rnf149_2
accgagcccatgtctcacgc

SEQ ID NO: 51264 - DNA, 20 bp, Artificial Sequence
  sgRNA
  Rnf149_3
tgatgatcatctcattagca

SEQ ID NO: 51265 - DNA, 20 bp, Artificial Sequence
  sgRNA
  Rnf149_4
cggagaaagctcgctccggg

SEQ ID NO: 51266 - DNA, 20 bp, Artificial Sequence
  sgRNA
  Rnf149_5
ggagcgagctttctccgaag

SEQ ID NO: 51267 - DNA, 20 bp, Artificial Sequence
  sgRNA
  Rnf149_6
cacgtattcgatgctcacca

SEQ ID NO: 51268 - DNA, 20 bp, Artificial Sequence
  sgRNA
  Rnf149_7
catatgcaggagttcatcag

SEQ ID NO: 51269 - DNA, 20 bp, Artificial Sequence
  sgRNA
  Rnf149_8
gtagctcctgcgtatcctca

SEQ ID NO: 51270 - DNA, 20 bp, Artificial Sequence
  sgRNA
  Rnf149_9
gactcgctcgaggaagatga

SEQ ID NO: 51271 - DNA, 20 bp, Artificial Sequence
  sgRNA
  Rnf149_10
gctcgagtggtactcggcca

SEQ ID NO: 51272 - DNA, 20 bp, Artificial Sequence
  sgRNA
  Rnf149_11
ggacccgcagtcgaacctga

SEQ ID NO: 51273 - DNA, 20 bp, Artificial Sequence
  sgRNA
  Rnf149_12
gtttacacattggacacgtt

SEQ ID NO: 51274 - DNA, 20 bp, Artificial Sequence
  sgRNA
  Rnf149_13
gcttcggagaaagctcgctc

SEQ ID NO: 51275 - DNA, 20 bp, Artificial Sequence
  sgRNA
  Rnf149_14
gattagctacccaaaaggac

SEQ ID NO: 51276 - DNA, 20 bp, Artificial Sequence
  sgRNA
  Rnf149_15
tgacatcccaagatgaggag

SEQ ID NO: 51277 - DNA, 20 bp, Artificial Sequence
  sgRNA
  Rnf149_16
tgattagctacccaaaagga

SEQ ID NO: 51278 - DNA, 20 bp, Artificial Sequence
  sgRNA
  Rnf149_17
ccatgcttcacagtgtgtag

SEQ ID NO: 51279 - DNA, 20 bp, Artificial Sequence
  sgRNA
  Rnf149_18
gtaaaaatgcggatagagat

SEQ ID NO: 51280 - DNA, 20 bp, Artificial Sequence
  sgRNA
  Rnf149_19
tctacaacctggagagcaac

SEQ ID NO: 51281 - DNA, 20 bp, Artificial Sequence
  sgRNA
  Rnf149_20
gttgtagaccaccacggccg

SEQ ID NO: 51282 - DNA, 20 bp, Artificial Sequence
  sgRNA
  Rnf150_1
agacaaacacaaccgacgtg

SEQ ID NO: 51283 - DNA, 20 bp, Artificial Sequence
  sgRNA
  Rnf150_2
gagcgagtgcgggcgatacg

SEQ ID NO: 51284 - DNA, 20 bp, Artificial Sequence
  sgRNA
  Rnf150_3
accatcaccatgccccacgc

SEQ ID NO: 51285 - DNA, 20 bp, Artificial Sequence
  sgRNA
  Rnf150_4
caaataggtgatgttcacga

SEQ ID NO: 51286 - DNA, 20 bp, Artificial Sequence
  sgRNA
  Rnf150_5
aaaatatgtgagccgcacgt

SEQ ID NO: 51287 - DNA, 20 bp, Artificial Sequence
  sgRNA
  Rnf150_6
gctctgcctggacttcaccg

SEQ ID NO: 51288 - DNA, 20 bp, Artificial Sequence
  sgRNA
  Rnf150_7
gttaaagatgaccacagcgg

SEQ ID NO: 51289 - DNA, 20 bp, Artificial Sequence
  sgRNA
  Rnf150_8
gctgtggtcatctttaacgt

SEQ ID NO: 51290 - DNA, 20 bp, Artificial Sequence
  sgRNA
  Rnf150_9
atgttgagagagccagactg

SEQ ID NO: 51291 - DNA, 20 bp, Artificial Sequence
  sgRNA
  Rnf150_10
gcacgtacagggataagatc

SEQ ID NO: 51292 - DNA, 20 bp, Artificial Sequence
  sgRNA
  Rnf150_11
gtgacgatgtacatcaccat

SEQ ID NO: 51293 - DNA, 20 bp, Artificial Sequence
  sgRNA
  Rnf150_12
tgttggggtcgcaagccagg

SEQ ID NO: 51294 - DNA, 20 bp, Artificial Sequence
  sgRNA
  Rnf150_13
ttccactgaccaagactgcg

SEQ ID NO: 51295 - DNA, 20 bp, Artificial Sequence
  sgRNA
  Rnf150_14
tggatagccctcatccccaa

SEQ ID NO: 51296 - DNA, 20 bp, Artificial Sequence
  sgRNA
  Rnf150_15
agagagccctcaaaatcaat

SEQ ID NO: 51297 - DNA, 20 bp, Artificial Sequence
  sgRNA
  Rnf150_16
ctatttggagcccgagcccg

SEQ ID NO: 51298 - DNA, 20 bp, Artificial Sequence
  sgRNA
  Rnf150_17
gcagtctggctctctcaaca

SEQ ID NO: 51299 - DNA, 20 bp, Artificial Sequence
  sgRNA
  Rnf150_18
acaagtcctgtgttgacccc

SEQ ID NO: 51300 - DNA, 20 bp, Artificial Sequence
  sgRNA
  Rnf150_19
tgaacattcttaaggcccta

SEQ ID NO: 51301 - DNA, 20 bp, Artificial Sequence
  sgRNA
  Rnf150_20
actgtgcagtctgcatagag

SEQ ID NO: 51302 - DNA, 20 bp, Artificial Sequence
  sgRNA
  Rnf167_1
aaagactgacccattgaccg

SEQ ID NO: 51303 - DNA, 20 bp, Artificial Sequence
  sgRNA
  Rnf167_2
ggaatgaggtaatagcccaa

SEQ ID NO: 51304 - DNA, 20 bp, Artificial Sequence
  sgRNA
  Rnf167_3
cagtccctcgtcgctcagag

SEQ ID NO: 51305 - DNA, 20 bp, Artificial Sequence
  sgRNA
  Rnf167_4
tggatgcaacgaactatcta

SEQ ID NO: 51306 - DNA, 20 bp, Artificial Sequence
  sgRNA
  Rnf167_5
ataaagactgacccattgac

SEQ ID NO: 51307 - DNA, 20 bp, Artificial Sequence
  sgRNA
  Rnf167_6
tctgcaaacagcctgtacat

SEQ ID NO: 51308 - DNA, 20 bp, Artificial Sequence
  sgRNA
  Rnf167_7
cctacccatgactatcagaa

SEQ ID NO: 51309 - DNA, 20 bp, Artificial Sequence
  sgRNA
  Rnf167_8
cgtagacaaaaagggctcgt

SEQ ID NO: 51310 - DNA, 20 bp, Artificial Sequence
  sgRNA
  Rnf167_9
agtacagtagccacgacaac

SEQ ID NO: 51311 - DNA, 20 bp, Artificial Sequence
  sgRNA
  Rnf167_10
tcgaatcagccctcggacag

SEQ ID NO: 51312 - DNA, 20 bp, Artificial Sequence
  sgRNA
  Rnf167_11
tgtgctccgaagtctgcaga

SEQ ID NO: 51313 - DNA, 20 bp, Artificial Sequence
  sgRNA
  Rnf167_12
gtagggctagagcccaggag

SEQ ID NO: 51314 - DNA, 20 bp, Artificial Sequence
  sgRNA
  Rnf167_13
gtagccacgacaacaggaag

SEQ ID NO: 51315 - DNA, 20 bp, Artificial Sequence
  sgRNA
  Rnf167_14
attacctcattcctttcact

SEQ ID NO: 51316 - DNA, 20 bp, Artificial Sequence
  sgRNA
  Rnf167_15
tagttcgttgcatccagcac

SEQ ID NO: 51317 - DNA, 20 bp, Artificial Sequence
  sgRNA
  Rnf167_16
gcagcagatgaaggaggtga

SEQ ID NO: 51318 - DNA, 20 bp, Artificial Sequence
  sgRNA
  Rnf167_17
ccccttctcgtagacaaaaa

SEQ ID NO: 51319 - DNA, 20 bp, Artificial Sequence
  sgRNA
  Rnf167_18
ggggccactctgagcgacga

SEQ ID NO: 51320 - DNA, 20 bp, Artificial Sequence
  sgRNA
  Rnf167_19
tgtacaggctgtttgcagat

SEQ ID NO: 51321 - DNA, 20 bp, Artificial Sequence
  sgRNA
  Rnf167_20
gctagggatccaaaggaggt

SEQ ID NO: 51322 - DNA, 20 bp, Artificial Sequence
  sgRNA
  Rnf43_1
gtagacgagcccgagccgag

SEQ ID NO: 51323 - DNA, 20 bp, Artificial Sequence
  sgRNA
  Rnf43_2
acgttcgatgaaactcgtgg

SEQ ID NO: 51324 - DNA, 20 bp, Artificial Sequence
  sgRNA
  Rnf43_3
gtgtgcacagtcaagtccgg

SEQ ID NO: 51325 - DNA, 20 bp, Artificial Sequence
  sgRNA
  Rnf43_4
gcaagttcaaaagaccgctg

SEQ ID NO: 51326 - DNA, 20 bp, Artificial Sequence
  sgRNA
  Rnf43_5
actggcttagtcagccccag

SEQ ID NO: 51327 - DNA, 20 bp, Artificial Sequence
  sgRNA
  Rnf43_6
gtaccactgagtccagcgag

SEQ ID NO: 51328 - DNA, 20 bp, Artificial Sequence
  sgRNA
  Rnf43_7
caatgcttcccaacccacaa

SEQ ID NO: 51329 - DNA, 20 bp, Artificial Sequence
  sgRNA
  Rnf43_8
cctggggctgactaagccag

SEQ ID NO: 51330 - DNA, 20 bp, Artificial Sequence
  sgRNA
  Rnf43_9
ggaccatgcttacctggaga

SEQ ID NO: 51331 - DNA, 20 bp, Artificial Sequence
  sgRNA
  Rnf43_10
ctacgatgttgaacatgcag

SEQ ID NO: 51332 - DNA, 20 bp, Artificial Sequence
  sgRNA
  Rnf43_11
ccagccacatacactatcac

SEQ ID NO: 51333 - DNA, 20 bp, Artificial Sequence
  sgRNA
  Rnf43_12
aggaaaactgaacctcactt

SEQ ID NO: 51334 - DNA, 20 bp, Artificial Sequence
  sgRNA
  Rnf43_13
gctgtgaacttgagtaacag

SEQ ID NO: 51335 - DNA, 20 bp, Artificial Sequence
  sgRNA
  Rnf43_14
tgcaagttcaaaagaccgct

SEQ ID NO: 51336 - DNA, 20 bp, Artificial Sequence
  sgRNA
  Rnf43_15
gcaaccctgcacgcaggctt

SEQ ID NO: 51337 - DNA, 20 bp, Artificial Sequence
  sgRNA
  Rnf43_16
agtactctttgacatcaccg

SEQ ID NO: 51338 - DNA, 20 bp, Artificial Sequence
  sgRNA
  Rnf43_17
tcactggatgagccgtgaca

SEQ ID NO: 51339 - DNA, 20 bp, Artificial Sequence
  sgRNA
  Rnf43_18
gtttgtgtacaagaatcgga

SEQ ID NO: 51340 - DNA, 20 bp, Artificial Sequence
  sgRNA
  Rnf43_19
cgtggaggcacgaaatgacc

SEQ ID NO: 51341 - DNA, 20 bp, Artificial Sequence
  sgRNA
  Rnf43_20
agtgtgcacagtcaagtccg

SEQ ID NO: 51342 - DNA, 20 bp, Artificial Sequence
  sgRNA
  Rnft1_1
agtgtaatataagaggacgg

SEQ ID NO: 51343 - DNA, 20 bp, Artificial Sequence
  sgRNA
  Rnft1_2
tcttgaatgaccacacgggg

SEQ ID NO: 51344 - DNA, 20 bp, Artificial Sequence
  sgRNA
  Rnft1_3
caagtacagacgcctgacct

SEQ ID NO: 51345 - DNA, 20 bp, Artificial Sequence
  sgRNA
  Rnft1_4
gagatagcggaattctgaga

SEQ ID NO: 51346 - DNA, 20 bp, Artificial Sequence
  sgRNA
  Rnft1_5
acaccagtaaccaagcacag

SEQ ID NO: 51347 - DNA, 20 bp, Artificial Sequence
  sgRNA
  Rnft1_6
gttgatcttgaatgaccaca

SEQ ID NO: 51348 - DNA, 20 bp, Artificial Sequence
  sgRNA
  Rnft1_7
tcggtaccttataagctacg

SEQ ID NO: 51349 - DNA, 20 bp, Artificial Sequence
  sgRNA
  Rnft1_8
tcttcatgtgcagtgcccgg

SEQ ID NO: 51350 - DNA, 20 bp, Artificial Sequence
  sgRNA
  Rnft1_9
tttggatatgtacatcccca

SEQ ID NO: 51351 - DNA, 20 bp, Artificial Sequence
  sgRNA
  Rnft1_10
gcaaccacttgaagagatag

SEQ ID NO: 51352 - DNA, 20 bp, Artificial Sequence
  sgRNA
  Rnft1_11
cttcactgtgggagtaactc

SEQ ID NO: 51353 - DNA, 20 bp, Artificial Sequence
  sgRNA
  Rnft1_12
tttcggtaccttataagcta

SEQ ID NO: 51354 - DNA, 20 bp, Artificial Sequence
  sgRNA
  Rnft1_13
ggtcattcaagatcaacaga

SEQ ID NO: 51355 - DNA, 20 bp, Artificial Sequence
  sgRNA
  Rnft1_14
acacttgagaactttcagac

SEQ ID NO: 51356 - DNA, 20 bp, Artificial Sequence
  sgRNA
  Rnft1_15
agaaggttcccttcaccctg

SEQ ID NO: 51357 - DNA, 20 bp, Artificial Sequence
  sgRNA
  Rnft1_16
gtacatatccaaataaactc

SEQ ID NO: 51358 - DNA, 20 bp, Artificial Sequence
  sgRNA
  Rnft1_17
aattccgctatctcttcaag

SEQ ID NO: 51359 - DNA, 20 bp, Artificial Sequence
  sgRNA
  Rnft1_18
atgtacatccccagggtgaa

SEQ ID NO: 51360 - DNA, 20 bp, Artificial Sequence
  sgRNA
  Rnft1_19
ataaggtaccgaaaccaaac

SEQ ID NO: 51361 - DNA, 20 bp, Artificial Sequence
  sgRNA
  Rnft1_20
gcatcttcatgtgcagtgcc

SEQ ID NO: 51362 - DNA, 20 bp, Artificial Sequence
  sgRNA
  Robo1_1
ttcgatgtaagcgctccacg

SEQ ID NO: 51363 - DNA, 20 bp, Artificial Sequence
  sgRNA
  Robo1_2
gctggacgttcgtaatggtg

SEQ ID NO: 51364 - DNA, 20 bp, Artificial Sequence
  sgRNA
  Robo1_3
gatacagttacacttcgggg

SEQ ID NO: 51365 - DNA, 20 bp, Artificial Sequence
  sgRNA
  Robo1_4
ctgggtctcttcacaaacga

SEQ ID NO: 51366 - DNA, 20 bp, Artificial Sequence
  sgRNA
  Robo1_5
ctaaccactccgattcacca

SEQ ID NO: 51367 - DNA, 20 bp, Artificial Sequence
  sgRNA
  Robo1_6
agaccgctggacgttcgtaa

SEQ ID NO: 51368 - DNA, 20 bp, Artificial Sequence
  sgRNA
  Robo1_7
tcaccattacgaacgtccag

SEQ ID NO: 51369 - DNA, 20 bp, Artificial Sequence
  sgRNA
  Robo1_8
ggaagagtaggcccgacgaa

SEQ ID NO: 51370 - DNA, 20 bp, Artificial Sequence
  sgRNA
  Robo1_9
aagatgacccgcgctcacac

SEQ ID NO: 51371 - DNA, 20 bp, Artificial Sequence
  sgRNA
  Robo1_10
tttgtaccattctatcgtcg

SEQ ID NO: 51372 - DNA, 20 bp, Artificial Sequence
  sgRNA
  Robo1_11
gtaccattctatcgtcgggg

SEQ ID NO: 51373 - DNA, 20 bp, Artificial Sequence
  sgRNA
  Robo1_12
catgttacaggattgtccgg

SEQ ID NO: 51374 - DNA, 20 bp, Artificial Sequence
  sgRNA
  Robo1_13
ggaaatgttgtcctcttccg

SEQ ID NO: 51375 - DNA, 20 bp, Artificial Sequence
  sgRNA
  Robo1_14
ccaatgcctgcaatgaacgc

SEQ ID NO: 51376 - DNA, 20 bp, Artificial Sequence
  sgRNA
  Robo1_15
tgtgtggcagaaaatatggt

SEQ ID NO: 51377 - DNA, 20 bp, Artificial Sequence
  sgRNA
  Robo1_16
tgcaccgcatcgacccccag

SEQ ID NO: 51378 - DNA, 20 bp, Artificial Sequence
  sgRNA
  Robo1_17
gcttctatagacgcgagttt

SEQ ID NO: 51379 - DNA, 20 bp, Artificial Sequence
  sgRNA
  Robo1_18
tctgccggagacacccacag

SEQ ID NO: 51380 - DNA, 20 bp, Artificial Sequence
  sgRNA
  Robo1_19
ggtcttataacagctcagat

SEQ ID NO: 51381 - DNA, 20 bp, Artificial Sequence
  sgRNA
  Robo1_20
ccgacgatagaatggtacaa

SEQ ID NO: 51382 - DNA, 20 bp, Artificial Sequence
  sgRNA
  Robo2_1
gatgatgcagacttgccgag

SEQ ID NO: 51383 - DNA, 20 bp, Artificial Sequence
  sgRNA
  Robo2_2
ttacatccctgactaccgat

SEQ ID NO: 51384 - DNA, 20 bp, Artificial Sequence
  sgRNA
  Robo2_3
tagacaatccctcagccaat

SEQ ID NO: 51385 - DNA, 20 bp, Artificial Sequence
  sgRNA
  Robo2_4
gcagaagtaaaccggacgaa

SEQ ID NO: 51386 - DNA, 20 bp, Artificial Sequence
  sgRNA
  Robo2_5
gccagctattgctcaccgat

SEQ ID NO: 51387 - DNA, 20 bp, Artificial Sequence
  sgRNA
  Robo2_6
ggaactcgttaaaatacggc

SEQ ID NO: 51388 - DNA, 20 bp, Artificial Sequence
  sgRNA
  Robo2_7
agagcactagaccagacacc

SEQ ID NO: 51389 - DNA, 20 bp, Artificial Sequence
  sgRNA
  Robo2_8
catctgccaggccctaaccg

SEQ ID NO: 51390 - DNA, 20 bp, Artificial Sequence
  sgRNA
  Robo2_9
tggagacgatgacatcagaa

SEQ ID NO: 51391 - DNA, 20 bp, Artificial Sequence
  sgRNA
  Robo2_10
gccagtgttacctcatcgga

SEQ ID NO: 51392 - DNA, 20 bp, Artificial Sequence
  sgRNA
  Robo2_11
gtttggatggtggtcccggg

SEQ ID NO: 51393 - DNA, 20 bp, Artificial Sequence
  sgRNA
  Robo2_12
tgctagctgccacttctacc

SEQ ID NO: 51394 - DNA, 20 bp, Artificial Sequence
  sgRNA
  Robo2_13
gctccggacacgtaacctaa

SEQ ID NO: 51395 - DNA, 20 bp, Artificial Sequence
  sgRNA
  Robo2_14
cttgtagtcccgaagtctga

SEQ ID NO: 51396 - DNA, 20 bp, Artificial Sequence
  sgRNA
  Robo2_15
gtgtattgctgagaatcggg

SEQ ID NO: 51397 - DNA, 20 bp, Artificial Sequence
  sgRNA
  Robo2_16
ccgtgggcgacactgaacat

SEQ ID NO: 51398 - DNA, 20 bp, Artificial Sequence
  sgRNA
  Robo2_17
ctgcgactaccacatctgtg

SEQ ID NO: 51399 - DNA, 20 bp, Artificial Sequence
  sgRNA
  Robo2_18
ttggagtgccagccaccacg

SEQ ID NO: 51400 - DNA, 20 bp, Artificial Sequence
  sgRNA
  Robo2_19
attccatatcaataaaacgg

SEQ ID NO: 51401 - DNA, 20 bp, Artificial Sequence
  sgRNA
  Robo2_20
tcatgggcgcagaagtaaac

SEQ ID NO: 51402 - DNA, 20 bp, Artificial Sequence
  sgRNA
  Robo3_1
tctgcgtagaccaataaacc

SEQ ID NO: 51403 - DNA, 20 bp, Artificial Sequence
  sgRNA
  Robo3_2
ggcctcgacccaacatcgag

SEQ ID NO: 51404 - DNA, 20 bp, Artificial Sequence
  sgRNA
  Robo3_3
catcactgaagtaaagatcg

SEQ ID NO: 51405 - DNA, 20 bp, Artificial Sequence
  sgRNA
  Robo3_4
tgtggccaagagttccatag

SEQ ID NO: 51406 - DNA, 20 bp, Artificial Sequence
  sgRNA
  Robo3_5
gtgcactgctggctgtacta

SEQ ID NO: 51407 - DNA, 20 bp, Artificial Sequence
  sgRNA
  Robo3_6
ggactgtgctcccttctgta

SEQ ID NO: 51408 - DNA, 20 bp, Artificial Sequence
  sgRNA
  Robo3_7
gagactaagaggcgtcccat

SEQ ID NO: 51409 - DNA, 20 bp, Artificial Sequence
  sgRNA
  Robo3_8
tcgaatccggaagaaaccca

SEQ ID NO: 51410 - DNA, 20 bp, Artificial Sequence
  sgRNA
  Robo3_9
ctctgagtagccatgacgga

SEQ ID NO: 51411 - DNA, 20 bp, Artificial Sequence
  sgRNA
  Robo3_10
cgacgcccgtgcacaatgcg

SEQ ID NO: 51412 - DNA, 20 bp, Artificial Sequence
  sgRNA
  Robo3_11
cttctgacgccggtagaggg

SEQ ID NO: 51413 - DNA, 20 bp, Artificial Sequence
  sgRNA
  Robo3_12
tacttggctcagactgcacg

SEQ ID NO: 51414 - DNA, 20 bp, Artificial Sequence
  sgRNA
  Robo3_13
gttcgcggactccctggcca

SEQ ID NO: 51415 - DNA, 20 bp, Artificial Sequence
  sgRNA
  Robo3_14
ggaaagaagagggcgccgct

SEQ ID NO: 51416 - DNA, 20 bp, Artificial Sequence
  sgRNA
  Robo3_15
gtttcttccggattcgagca

SEQ ID NO: 51417 - DNA, 20 bp, Artificial Sequence
  sgRNA
  Robo3_16
aactccagcgagctactctt

SEQ ID NO: 51418 - DNA, 20 bp, Artificial Sequence
  sgRNA
  Robo3_17
acttccctcccagcgaaatg

SEQ ID NO: 51419 - DNA, 20 bp, Artificial Sequence
  sgRNA
  Robo3_18
cctagaagaattgctaccag

SEQ ID NO: 51420 - DNA, 20 bp, Artificial Sequence
  sgRNA
  Robo3_19
agcttcctgagccatggcca

SEQ ID NO: 51421 - DNA, 20 bp, Artificial Sequence
  sgRNA
  Robo3_20
aggattgcaggccttgacca

SEQ ID NO: 51422 - DNA, 20 bp, Artificial Sequence
  sgRNA
  Ror1_1
agcacgggtgtagactaccg

SEQ ID NO: 51423 - DNA, 20 bp, Artificial Sequence
  sgRNA
  Ror1_2
tcatcacgacacaagtcacg

SEQ ID NO: 51424 - DNA, 20 bp, Artificial Sequence
  sgRNA
  Ror1_3
acttcaagtgaaatcgacaa

SEQ ID NO: 51425 - DNA, 20 bp, Artificial Sequence
  sgRNA
  Ror1_4
acagccgacatcggaatgcg

SEQ ID NO: 51426 - DNA, 20 bp, Artificial Sequence
  sgRNA
  Ror1_5
ggattctgtcagccgtaccg

SEQ ID NO: 51427 - DNA, 20 bp, Artificial Sequence
  sgRNA
  Ror1_6
gcccggaaggagattctccg

SEQ ID NO: 51428 - DNA, 20 bp, Artificial Sequence
  sgRNA
  Ror1_7
ataacatcacaacgtccctg

SEQ ID NO: 51429 - DNA, 20 bp, Artificial Sequence
  sgRNA
  Ror1_8
attacatgttcccgagccaa

SEQ ID NO: 51430 - DNA, 20 bp, Artificial Sequence
  sgRNA
  Ror1_9
ggtttcgtcacagtacggga

SEQ ID NO: 51431 - DNA, 20 bp, Artificial Sequence
  sgRNA
  Ror1_10
cgctttccggagctcaacgg

SEQ ID NO: 51432 - DNA, 20 bp, Artificial Sequence
  sgRNA
  Ror1_11
gctggttctgaggtatcgct

SEQ ID NO: 51433 - DNA, 20 bp, Artificial Sequence
  sgRNA
  Ror1_12
ttatttataggatccgccat

SEQ ID NO: 51434 - DNA, 20 bp, Artificial Sequence
  sgRNA
  Ror1_13
gcacatgcaatgcctcggta

SEQ ID NO: 51435 - DNA, 20 bp, Artificial Sequence
  sgRNA
  Ror1_14
gcagtggacagaatttcaac

SEQ ID NO: 51436 - DNA, 20 bp, Artificial Sequence
  sgRNA
  Ror1_15
gcatgatgaggaactcgtgg

SEQ ID NO: 51437 - DNA, 20 bp, Artificial Sequence
  sgRNA
  Ror1_16
tggtggcatttccacccgag

SEQ ID NO: 51438 - DNA, 20 bp, Artificial Sequence
  sgRNA
  Ror1_17
gctgtagcagtgatgaagat

SEQ ID NO: 51439 - DNA, 20 bp, Artificial Sequence
  sgRNA
  Ror1_18
tggtcacactgacggttccc

SEQ ID NO: 51440 - DNA, 20 bp, Artificial Sequence
  sgRNA
  Ror1_19
tcaattccaaatcaccctgg

SEQ ID NO: 51441 - DNA, 20 bp, Artificial Sequence
  sgRNA
  Ror1_20
caccagctctaccaccccct

SEQ ID NO: 51442 - DNA, 20 bp, Artificial Sequence
  sgRNA
  Ror2_1
agagaatacatactacacgg

SEQ ID NO: 51443 - DNA, 20 bp, Artificial Sequence
  sgRNA
  Ror2_2
tggtggcgcagatcgctgcg

SEQ ID NO: 51444 - DNA, 20 bp, Artificial Sequence
  sgRNA
  Ror2_3
gctctggcgccgattacagg

SEQ ID NO: 51445 - DNA, 20 bp, Artificial Sequence
  sgRNA
  Ror2_4
ctggtctgacagttgcgtgg

SEQ ID NO: 51446 - DNA, 20 bp, Artificial Sequence
  sgRNA
  Ror2_5
tcgtggctcttgcacaaccg

SEQ ID NO: 51447 - DNA, 20 bp, Artificial Sequence
  sgRNA
  Ror2_6
gcttctgccagccgtaccga

SEQ ID NO: 51448 - DNA, 20 bp, Artificial Sequence
  sgRNA
  Ror2_7
gcagaataaaaacgtacgcg

SEQ ID NO: 51449 - DNA, 20 bp, Artificial Sequence
  sgRNA
  Ror2_8
gcacaagcgatccctcggta

SEQ ID NO: 51450 - DNA, 20 bp, Artificial Sequence
  sgRNA
  Ror2_9
catgcgcatcgggatcccgg

SEQ ID NO: 51451 - DNA, 20 bp, Artificial Sequence
  sgRNA
  Ror2_10
gctgcgaactgcatgcgcat

SEQ ID NO: 51452 - DNA, 20 bp, Artificial Sequence
  sgRNA
  Ror2_11
acactggtctgacagttgcg

SEQ ID NO: 51453 - DNA, 20 bp, Artificial Sequence
  sgRNA
  Ror2_12
agtgatggtcttcagcccgt

SEQ ID NO: 51454 - DNA, 20 bp, Artificial Sequence
  sgRNA
  Ror2_13
ctgtggatgtccttaaagcg

SEQ ID NO: 51455 - DNA, 20 bp, Artificial Sequence
  sgRNA
  Ror2_14
tgacacgctccaggtgaccg

SEQ ID NO: 51456 - DNA, 20 bp, Artificial Sequence
  sgRNA
  Ror2_15
ccaggtccttatggaccacg

SEQ ID NO: 51457 - DNA, 20 bp, Artificial Sequence
  sgRNA
  Ror2_16
catccgctggatgtcccccg

SEQ ID NO: 51458 - DNA, 20 bp, Artificial Sequence
  sgRNA
  Ror2_17
accacgtgcacgaagtccgg

SEQ ID NO: 51459 - DNA, 20 bp, Artificial Sequence
  sgRNA
  Ror2_18
tccgccacagatgtattgga

SEQ ID NO: 51460 - DNA, 20 bp, Artificial Sequence
  sgRNA
  Ror2_19
attccagcattcaatcatga

SEQ ID NO: 51461 - DNA, 20 bp, Artificial Sequence
  sgRNA
  Ror2_20
tggttggagtacccacagta

SEQ ID NO: 51462 - DNA, 20 bp, Artificial Sequence
  sgRNA
  Ros1_1
gggttgtagaacatgttgcg

SEQ ID NO: 51463 - DNA, 20 bp, Artificial Sequence
  sgRNA
  Ros1_2
agagatatgagatacggaca

SEQ ID NO: 51464 - DNA, 20 bp, Artificial Sequence
  sgRNA
  Ros1_3
gtcatggtgtgacattacgc

SEQ ID NO: 51465 - DNA, 20 bp, Artificial Sequence
  sgRNA
  Ros1_4
gtcactccttatacctactg

SEQ ID NO: 51466 - DNA, 20 bp, Artificial Sequence
  sgRNA
  Ros1_5
gctatagacatcctaggcgt

SEQ ID NO: 51467 - DNA, 20 bp, Artificial Sequence
  sgRNA
  Ros1_6
ggttagttacacaggacgtt

SEQ ID NO: 51468 - DNA, 20 bp, Artificial Sequence
  sgRNA
  Ros1_7
agttccagaataatgtactg

SEQ ID NO: 51469 - DNA, 20 bp, Artificial Sequence
  sgRNA
  Ros1_8
agttgaaaagacatcactgg

SEQ ID NO: 51470 - DNA, 20 bp, Artificial Sequence
  sgRNA
  Ros1_9
tcaccaatcttgactacccg

SEQ ID NO: 51471 - DNA, 20 bp, Artificial Sequence
  sgRNA
  Ros1_10
gctttggtgtccctgccaga

SEQ ID NO: 51472 - DNA, 20 bp, Artificial Sequence
  sgRNA
  Ros1_11
gtccaagctctcatacacgg

SEQ ID NO: 51473 - DNA, 20 bp, Artificial Sequence
  sgRNA
  Ros1_12
ttgttgatgactccaccggt

SEQ ID NO: 51474 - DNA, 20 bp, Artificial Sequence
  sgRNA
  Ros1_13
gagtaaaaattccatccagt

SEQ ID NO: 51475 - DNA, 20 bp, Artificial Sequence
  sgRNA
  Ros1_14
aatgcactgatgtactacag

SEQ ID NO: 51476 - DNA, 20 bp, Artificial Sequence
  sgRNA
  Ros1_15
ttagagtcttcacatccaaa

SEQ ID NO: 51477 - DNA, 20 bp, Artificial Sequence
  sgRNA
  Ros1_16
tctttcaatgaattcatcgt

SEQ ID NO: 51478 - DNA, 20 bp, Artificial Sequence
  sgRNA
  Ros1_17
gagatatccatcccattcag

SEQ ID NO: 51479 - DNA, 20 bp, Artificial Sequence
  sgRNA
  Ros1_18
ggatggctctgccttccacc

SEQ ID NO: 51480 - DNA, 20 bp, Artificial Sequence
  sgRNA
  Ros1_19
cagtcaagacaaacctcacg

SEQ ID NO: 51481 - DNA, 20 bp, Artificial Sequence
  sgRNA
  Ros1_20
taaactatgtgcaagcagga

SEQ ID NO: 51482 - DNA, 20 bp, Artificial Sequence
  sgRNA
  Rpn1_1
tctcccgctacgattaccag

SEQ ID NO: 51483 - DNA, 20 bp, Artificial Sequence
  sgRNA
  Rpn1_2
cgaggacgtgaagcgcacgg

SEQ ID NO: 51484 - DNA, 20 bp, Artificial Sequence
  sgRNA
  Rpn1_3
tcacttgctcatcaaacacg

SEQ ID NO: 51485 - DNA, 20 bp, Artificial Sequence
  sgRNA
  Rpn1_4
gtgagatacctcgatgaccc

SEQ ID NO: 51486 - DNA, 20 bp, Artificial Sequence
  sgRNA
  Rpn1_5
tgtaagccacaatcaccggg

SEQ ID NO: 51487 - DNA, 20 bp, Artificial Sequence
  sgRNA
  Rpn1_6
tcttaaccctggtcaacaag

SEQ ID NO: 51488 - DNA, 20 bp, Artificial Sequence
  sgRNA
  Rpn1_7
gtgaagatcatcttgcccga

SEQ ID NO: 51489 - DNA, 20 bp, Artificial Sequence
  sgRNA
  Rpn1_8
aggacgtcctcagatctcga

SEQ ID NO: 51490 - DNA, 20 bp, Artificial Sequence
  sgRNA
  Rpn1_9
acgtcctcgttgaccagcgg

SEQ ID NO: 51491 - DNA, 20 bp, Artificial Sequence
  sgRNA
  Rpn1_10
ggtgcactacacgttcaaca

SEQ ID NO: 51492 - DNA, 20 bp, Artificial Sequence
  sgRNA
  Rpn1_11
ggacgtcctcagatctcgag

SEQ ID NO: 51493 - DNA, 20 bp, Artificial Sequence
  sgRNA
  Rpn1_12
gtggtcctggtacacccggg

SEQ ID NO: 51494 - DNA, 20 bp, Artificial Sequence
  sgRNA
  Rpn1_13
ttcacgtcctcgttgaccag

SEQ ID NO: 51495 - DNA, 20 bp, Artificial Sequence
  sgRNA
  Rpn1_14
cctagacacgttcggccgcc

SEQ ID NO: 51496 - DNA, 20 bp, Artificial Sequence
  sgRNA
  Rpn1_15
acagtccctacgatatcagc

SEQ ID NO: 51497 - DNA, 20 bp, Artificial Sequence
  sgRNA
  Rpn1_16
gctgcctctggtaatcgtag

SEQ ID NO: 51498 - DNA, 20 bp, Artificial Sequence
  sgRNA
  Rpn1_17
ggacgccagtttcactcgca

SEQ ID NO: 51499 - DNA, 20 bp, Artificial Sequence
  sgRNA
  Rpn1_18
tcttgtaagccacaatcacc

SEQ ID NO: 51500 - DNA, 20 bp, Artificial Sequence
  sgRNA
  Rpn1_19
caacgaggacgtgaagcgca

SEQ ID NO: 51501 - DNA, 20 bp, Artificial Sequence
  sgRNA
  Rpn1_20
agtgaagatcatcttgcccg

SEQ ID NO: 51502 - DNA, 20 bp, Artificial Sequence
  sgRNA
  Rprm_1
gctgggcaaccagaccgacg

SEQ ID NO: 51503 - DNA, 20 bp, Artificial Sequence
  sgRNA
  Rprm_2
tgtacaggctgcgctcgtcg

SEQ ID NO: 51504 - DNA, 20 bp, Artificial Sequence
  sgRNA
  Rprm_3
gcgtcggtggtgaccgacga

SEQ ID NO: 51505 - DNA, 20 bp, Artificial Sequence
  sgRNA
  Rprm_4
gcgcctcgctactgttgacc

SEQ ID NO: 51506 - DNA, 20 bp, Artificial Sequence
  sgRNA
  Rprm_5
gaccgacgatggcttcgccg

SEQ ID NO: 51507 - DNA, 20 bp, Artificial Sequence
  sgRNA
  Rprm_6
actgcctccacctctttaga

SEQ ID NO: 51508 - DNA, 20 bp, Artificial Sequence
  sgRNA
  Rprm_7
cagcctgtacatcatgcgtg

SEQ ID NO: 51509 - DNA, 20 bp, Artificial Sequence
  sgRNA
  Rprm_8
gttcctggtcaacagtagcg

SEQ ID NO: 51510 - DNA, 20 bp, Artificial Sequence
  sgRNA
  Rprm_9
tccctcggcgaagccatcgt

SEQ ID NO: 51511 - DNA, 20 bp, Artificial Sequence
  sgRNA
  Rprm_10
ggtcaacagtagcgaggcgc

SEQ ID NO: 51512 - DNA, 20 bp, Artificial Sequence
  sgRNA
  Rprm_11
acttcctagtgaaggaccgg

SEQ ID NO: 51513 - DNA, 20 bp, Artificial Sequence
  sgRNA
  Rprm_12
tcaacttcctagtgaaggac

SEQ ID NO: 51514 - DNA, 20 bp, Artificial Sequence
  sgRNA
  Rprm_13
gacgatggcttcgccgaggg

SEQ ID NO: 51515 - DNA, 20 bp, Artificial Sequence
  sgRNA
  Rprm_14
aacctgctcatcaagtccga

SEQ ID NO: 51516 - DNA, 20 bp, Artificial Sequence
  sgRNA
  Rprm_15
gtcggtcaccaccgacgcct

SEQ ID NO: 51517 - DNA, 20 bp, Artificial Sequence
  sgRNA
  Rprm_16
gaggccgtctaaagaggtgg

SEQ ID NO: 51518 - DNA, 20 bp, Artificial Sequence
  sgRNA
  Rprm_17
cgtcggtcaccaccgacgcc

SEQ ID NO: 51519 - DNA, 20 bp, Artificial Sequence
  sgRNA
  Rprm_18
tgatgagcaggttgcagcca

SEQ ID NO: 51520 - DNA, 20 bp, Artificial Sequence
  sgRNA
  Rprm_19
gcaccacacgcatgatgtac

SEQ ID NO: 51521 - DNA, 20 bp, Artificial Sequence
  sgRNA
  Rprm_20
gtctaaagaggtggaggcag

SEQ ID NO: 51522 - DNA, 20 bp, Artificial Sequence
  sgRNA
  Rprml_1
cgtccggcgccagtcctgcg

SEQ ID NO: 51523 - DNA, 20 bp, Artificial Sequence
  sgRNA
  Rprml_2
gtgagcttcctgaaccacag

SEQ ID NO: 51524 - DNA, 20 bp, Artificial Sequence
  sgRNA
  Rprml_3
gccggacgaacgcagcctgt

SEQ ID NO: 51525 - DNA, 20 bp, Artificial Sequence
  sgRNA
  Rprml_4
accccgtcgctggcggtcag

SEQ ID NO: 51526 - DNA, 20 bp, Artificial Sequence
  sgRNA
  Rprml_5
ttgcgtgctgtcgctcaccg

SEQ ID NO: 51527 - DNA, 20 bp, Artificial Sequence
  sgRNA
  Rprml_6
gcaccactgaccgccagcga

SEQ ID NO: 51528 - DNA, 20 bp, Artificial Sequence
  sgRNA
  Rprml_7
cagcctgtgggtgtcgcgcg

SEQ ID NO: 51529 - DNA, 20 bp, Artificial Sequence
  sgRNA
  Rprml_8
gaagaaaacgccgaagacca

SEQ ID NO: 51530 - DNA, 20 bp, Artificial Sequence
  sgRNA
  Rprml_9
gcgcaggccctccaaggacg

SEQ ID NO: 51531 - DNA, 20 bp, Artificial Sequence
  sgRNA
  Rprml_10
ctagccacgtgcccagcccg

SEQ ID NO: 51532 - DNA, 20 bp, Artificial Sequence
  sgRNA
  Rprml_11
actttctgatgcaggagcgc

SEQ ID NO: 51533 - DNA, 20 bp, Artificial Sequence
  sgRNA
  Rprml_12
accactgaccgccagcgacg

SEQ ID NO: 51534 - DNA, 20 bp, Artificial Sequence
  sgRNA
  Rprml_13
tgatgagcaggttacagccc

SEQ ID NO: 51535 - DNA, 20 bp, Artificial Sequence
  sgRNA
  Rprml_14
tggctagactgctgccccgg

SEQ ID NO: 51536 - DNA, 20 bp, Artificial Sequence
  sgRNA
  Rprml_15
acgtggctagactgctgccc

SEQ ID NO: 51537 - DNA, 20 bp, Artificial Sequence
  sgRNA
  Rprml_16
gagcgacagcacgcaaagca

SEQ ID NO: 51538 - DNA, 20 bp, Artificial Sequence
  sgRNA
  Rprml_17
gcaggagcgcaggccctcca

SEQ ID NO: 51539 - DNA, 20 bp, Artificial Sequence
  sgRNA
  Rprml_18
gtggctgcggtttcccaggg

SEQ ID NO: 51540 - DNA, 20 bp, Artificial Sequence
  sgRNA
  Rprml_19
cccgtggctgcggtttccca

SEQ ID NO: 51541 - DNA, 20 bp, Artificial Sequence
  sgRNA
  Rprml_20
cgcaggccctccaaggacgt

SEQ ID NO: 51542 - DNA, 20 bp, Artificial Sequence
  sgRNA
  Rrh_1
gactgagcacagcgtcatag

SEQ ID NO: 51543 - DNA, 20 bp, Artificial Sequence
  sgRNA
  Rrh_2
tcatcaagtacaaggagctg

SEQ ID NO: 51544 - DNA, 20 bp, Artificial Sequence
  sgRNA
  Rrh_3
actagcggcgtagagtctca

SEQ ID NO: 51545 - DNA, 20 bp, Artificial Sequence
  sgRNA
  Rrh_4
catcggctatcccatgtctg

SEQ ID NO: 51546 - DNA, 20 bp, Artificial Sequence
  sgRNA
  Rrh_5
gcgcagccacgtaaatacag

SEQ ID NO: 51547 - DNA, 20 bp, Artificial Sequence
  sgRNA
  Rrh_6
ttatgccccggatcctacag

SEQ ID NO: 51548 - DNA, 20 bp, Artificial Sequence
  sgRNA
  Rrh_7
ctacaacccctgtatttacg

SEQ ID NO: 51549 - DNA, 20 bp, Artificial Sequence
  sgRNA
  Rrh_8
ggtgagcattggcttactca

SEQ ID NO: 51550 - DNA, 20 bp, Artificial Sequence
  sgRNA
  Rrh_9
tgcgcagccacgtaaataca

SEQ ID NO: 51551 - DNA, 20 bp, Artificial Sequence
  sgRNA
  Rrh_10
gttatgccccggatcctaca

SEQ ID NO: 51552 - DNA, 20 bp, Artificial Sequence
  sgRNA
  Rrh_11
ggatatgcctcagagctcat

SEQ ID NO: 51553 - DNA, 20 bp, Artificial Sequence
  sgRNA
  Rrh_12
ccacgtgtaccataaactgg

SEQ ID NO: 51554 - DNA, 20 bp, Artificial Sequence
  sgRNA
  Rrh_13
tcacggttgtagctatggat

SEQ ID NO: 51555 - DNA, 20 bp, Artificial Sequence
  sgRNA
  Rrh_14
gctatgatagccattgaagg

SEQ ID NO: 51556 - DNA, 20 bp, Artificial Sequence
  sgRNA
  Rrh_15
acaagcccacaagcacacga

SEQ ID NO: 51557 - DNA, 20 bp, Artificial Sequence
  sgRNA
  Rrh_16
cctaaagctgactctacaga

SEQ ID NO: 51558 - DNA, 20 bp, Artificial Sequence
  sgRNA
  Rrh_17
gcaatgctggtggagccaag

SEQ ID NO: 51559 - DNA, 20 bp, Artificial Sequence
  sgRNA
  Rrh_18
gggctttgatgcccatcata

SEQ ID NO: 51560 - DNA, 20 bp, Artificial Sequence
  sgRNA
  Rrh_19
agttatgccccggatcctac

SEQ ID NO: 51561 - DNA, 20 bp, Artificial Sequence
  sgRNA
  Rrh_20
tgtacttgatgaagataccc

SEQ ID NO: 51562 - DNA, 20 bp, Artificial Sequence
  sgRNA
  Rtn4r_1
acactgcacctagaccgatg

SEQ ID NO: 51563 - DNA, 20 bp, Artificial Sequence
  sgRNA
  Rtn4r_2
gccgaaatctcactatcctg

SEQ ID NO: 51564 - DNA, 20 bp, Artificial Sequence
  sgRNA
  Rtn4r_3
tgtgtgctacaatgagccca

SEQ ID NO: 51565 - DNA, 20 bp, Artificial Sequence
  sgRNA
  Rtn4r_4
cagaggtcctaatgcccctg

SEQ ID NO: 51566 - DNA, 20 bp, Artificial Sequence
  sgRNA
  Rtn4r_5
gcacctctgatgaggaacct

SEQ ID NO: 51567 - DNA, 20 bp, Artificial Sequence
  sgRNA
  Rtn4r_6
gcgactcaatgacaacccct

SEQ ID NO: 51568 - DNA, 20 bp, Artificial Sequence
  sgRNA
  Rtn4r_7
cctggtggagtgtcaccggg

SEQ ID NO: 51569 - DNA, 20 bp, Artificial Sequence
  sgRNA
  Rtn4r_8
catgcagaaagagatgcgtg

SEQ ID NO: 51570 - DNA, 20 bp, Artificial Sequence
  sgRNA
  Rtn4r_9
gctagtccacggaataggcc

SEQ ID NO: 51571 - DNA, 20 bp, Artificial Sequence
  sgRNA
  Rtn4r_10
gtgggtgcacacgagccaca

SEQ ID NO: 51572 - DNA, 20 bp, Artificial Sequence
  sgRNA
  Rtn4r_11
gtgcctgagcacgctttccg

SEQ ID NO: 51573 - DNA, 20 bp, Artificial Sequence
  sgRNA
  Rtn4r_12
cctggtggctcggaaccccc

SEQ ID NO: 51574 - DNA, 20 bp, Artificial Sequence
  sgRNA
  Rtn4r_13
tgtagcacacacaagcacca

SEQ ID NO: 51575 - DNA, 20 bp, Artificial Sequence
  sgRNA
  Rtn4r_14
actgcagagctgctagtcca

SEQ ID NO: 51576 - DNA, 20 bp, Artificial Sequence
  sgRNA
  Rtn4r_15
gagctgctagtccacggaat

SEQ ID NO: 51577 - DNA, 20 bp, Artificial Sequence
  sgRNA
  Rtn4r_16
acaacaagctgcccccagca

SEQ ID NO: 51578 - DNA, 20 bp, Artificial Sequence
  sgRNA
  Rtn4r_17
cctcagtactggaacccggg

SEQ ID NO: 51579 - DNA, 20 bp, Artificial Sequence
  sgRNA
  Rtn4r_18
agtaccagtgcaaggcccag

SEQ ID NO: 51580 - DNA, 20 bp, Artificial Sequence
  sgRNA
  Rtn4r_19
gcatctggctggcagcactt

SEQ ID NO: 51581 - DNA, 20 bp, Artificial Sequence
  sgRNA
  Rtn4r_20
aagatctagttgctccagga

SEQ ID NO: 51582 - DNA, 20 bp, Artificial Sequence
  sgRNA
  Rtn4rl1_1
ccttcgcagccattcccaca

SEQ ID NO: 51583 - DNA, 20 bp, Artificial Sequence
  sgRNA
  Rtn4rl1_2
gggtagcacacacagtctcg

SEQ ID NO: 51584 - DNA, 20 bp, Artificial Sequence
  sgRNA
  Rtn4rl1_3
gccctctacctctataagtg

SEQ ID NO: 51585 - DNA, 20 bp, Artificial Sequence
  sgRNA
  Rtn4rl1_4
gcatgagaaccagctacagt

SEQ ID NO: 51586 - DNA, 20 bp, Artificial Sequence
  sgRNA
  Rtn4rl1_5
gtagatccagagggtgacca

SEQ ID NO: 51587 - DNA, 20 bp, Artificial Sequence
  sgRNA
  Rtn4rl1_6
gaacttgtgctgatagtcgg

SEQ ID NO: 51588 - DNA, 20 bp, Artificial Sequence
  sgRNA
  Rtn4rl1_7
tgcccaccgcacgacccaag

SEQ ID NO: 51589 - DNA, 20 bp, Artificial Sequence
  sgRNA
  Rtn4rl1_8
gaatggctgcgaaggttccg

SEQ ID NO: 51590 - DNA, 20 bp, Artificial Sequence
  sgRNA
  Rtn4rl1_9
gtgccagcgttcgcagctgt

SEQ ID NO: 51591 - DNA, 20 bp, Artificial Sequence
  sgRNA
  Rtn4rl1_10
aggccaccaaagatgcctgc

SEQ ID NO: 51592 - DNA, 20 bp, Artificial Sequence
  sgRNA
  Rtn4rl1_11
attgctcccaacaccttcga

SEQ ID NO: 51593 - DNA, 20 bp, Artificial Sequence
  sgRNA
  Rtn4rl1_12
agagggcgtgaagcttcacc

SEQ ID NO: 51594 - DNA, 20 bp, Artificial Sequence
  sgRNA
  Rtn4rl1_13
gctacagtgggttcaccaca

SEQ ID NO: 51595 - DNA, 20 bp, Artificial Sequence
  sgRNA
  Rtn4rl1_14
gttgttggagtagatccaga

SEQ ID NO: 51596 - DNA, 20 bp, Artificial Sequence
  sgRNA
  Rtn4rl1_15
ggagcaccatccgtcccatg

SEQ ID NO: 51597 - DNA, 20 bp, Artificial Sequence
  sgRNA
  Rtn4rl1_16
caactttgctgccatcccgg

SEQ ID NO: 51598 - DNA, 20 bp, Artificial Sequence
  sgRNA
  Rtn4rl1_17
taacctgacctggagccagg

SEQ ID NO: 51599 - DNA, 20 bp, Artificial Sequence
  sgRNA
  Rtn4rl1_18
cacgcttaccacctctgaca

SEQ ID NO: 51600 - DNA, 20 bp, Artificial Sequence
  sgRNA
  Rtn4rl1_19
gcccttcctcttgggtcgtg

SEQ ID NO: 51601 - DNA, 20 bp, Artificial Sequence
  sgRNA
  Rtn4rl1_20
gctgaacttgtgctgatagt

SEQ ID NO: 51602 - DNA, 20 bp, Artificial Sequence
  sgRNA
  Rtn4rl2_1
tgcagagcataggacagctg

SEQ ID NO: 51603 - DNA, 20 bp, Artificial Sequence
  sgRNA
  Rtn4rl2_2
gaactcgagcgccggcaggt

SEQ ID NO: 51604 - DNA, 20 bp, Artificial Sequence
  sgRNA
  Rtn4rl2_3
cacccaggatgacttgttcg

SEQ ID NO: 51605 - DNA, 20 bp, Artificial Sequence
  sgRNA
  Rtn4rl2_4
ctcacggagcacgtgttccg

SEQ ID NO: 51606 - DNA, 20 bp, Artificial Sequence
  sgRNA
  Rtn4rl2_5
tacggcggcgaggatcagcg

SEQ ID NO: 51607 - DNA, 20 bp, Artificial Sequence
  sgRNA
  Rtn4rl2_6
acaacctcatccgctcactg

SEQ ID NO: 51608 - DNA, 20 bp, Artificial Sequence
  sgRNA
  Rtn4rl2_7
gggcagatctcggtagagcg

SEQ ID NO: 51609 - DNA, 20 bp, Artificial Sequence
  sgRNA
  Rtn4rl2_8
gcaggaactcgagcgccggc

SEQ ID NO: 51610 - DNA, 20 bp, Artificial Sequence
  sgRNA
  Rtn4rl2_9
ccacctgtacggcgtggccg

SEQ ID NO: 51611 - DNA, 20 bp, Artificial Sequence
  sgRNA
  Rtn4rl2_10
ctaccgagatctgcccgccg

SEQ ID NO: 51612 - DNA, 20 bp, Artificial Sequence
  sgRNA
  Rtn4rl2_11
actgtaggctgaccaagcct

SEQ ID NO: 51613 - DNA, 20 bp, Artificial Sequence
  sgRNA
  Rtn4rl2_12
ggttcccgtgcagcaacagc

SEQ ID NO: 51614 - DNA, 20 bp, Artificial Sequence
  sgRNA
  Rtn4rl2_13
gctacggcggcgaggatcag

SEQ ID NO: 51615 - DNA, 20 bp, Artificial Sequence
  sgRNA
  Rtn4rl2_14
aagagctgttgccgcgggcg

SEQ ID NO: 51616 - DNA, 20 bp, Artificial Sequence
  sgRNA
  Rtn4rl2_15
gccctagaagaactggacct

SEQ ID NO: 51617 - DNA, 20 bp, Artificial Sequence
  sgRNA
  Rtn4rl2_16
ttccaaccacctgtacggcg

SEQ ID NO: 51618 - DNA, 20 bp, Artificial Sequence
  sgRNA
  Rtn4rl2_17
cctggaggtagaggtactgt

SEQ ID NO: 51619 - DNA, 20 bp, Artificial Sequence
  sgRNA
  Rtn4rl2_18
tgaggccgtggaaagccgcg

SEQ ID NO: 51620 - DNA, 20 bp, Artificial Sequence
  sgRNA
  Rtn4rl2_19
gctgggggtcacggaaggaa

SEQ ID NO: 51621 - DNA, 20 bp, Artificial Sequence
  sgRNA
  Rtn4rl2_20
gatctcggtagagcgtggac

SEQ ID NO: 51622 - DNA, 20 bp, Artificial Sequence
  sgRNA
  Rxfp1_1
tgagtggggaaattcgactg

SEQ ID NO: 51623 - DNA, 20 bp, Artificial Sequence
  sgRNA
  Rxfp1_2
gcgcagctgtaagcccaaca

SEQ ID NO: 51624 - DNA, 20 bp, Artificial Sequence
  sgRNA
  Rxfp1_3
aggtgctgactgcctaatgg

SEQ ID NO: 51625 - DNA, 20 bp, Artificial Sequence
  sgRNA
  Rxfp1_4
tttcaggagacaacaatggg

SEQ ID NO: 51626 - DNA, 20 bp, Artificial Sequence
  sgRNA
  Rxfp1_5
agatccttaaatatgttcgg

SEQ ID NO: 51627 - DNA, 20 bp, Artificial Sequence
  sgRNA
  Rxfp1_6
gctgtaagcccaacacggat

SEQ ID NO: 51628 - DNA, 20 bp, Artificial Sequence
  sgRNA
  Rxfp1_7
gggaatccagcacagcgcgt

SEQ ID NO: 51629 - DNA, 20 bp, Artificial Sequence
  sgRNA
  Rxfp1_8
tctcggcacaaacaatgcat

SEQ ID NO: 51630 - DNA, 20 bp, Artificial Sequence
  sgRNA
  Rxfp1_9
acaataagcacgcacagccg

SEQ ID NO: 51631 - DNA, 20 bp, Artificial Sequence
  sgRNA
  Rxfp1_10
tgctccatcattcatctggg

SEQ ID NO: 51632 - DNA, 20 bp, Artificial Sequence
  sgRNA
  Rxfp1_11
tggtacttcctgaagccgtt

SEQ ID NO: 51633 - DNA, 20 bp, Artificial Sequence
  sgRNA
  Rxfp1_12
gctgcttcactgcaatggtg

SEQ ID NO: 51634 - DNA, 20 bp, Artificial Sequence
  sgRNA
  Rxfp1_13
tggagcccagatttattcag

SEQ ID NO: 51635 - DNA, 20 bp, Artificial Sequence
  sgRNA
  Rxfp1_14
caatgaacactctccatcca

SEQ ID NO: 51636 - DNA, 20 bp, Artificial Sequence
  sgRNA
  Rxfp1_15
aaactagcgacagatcacag

SEQ ID NO: 51637 - DNA, 20 bp, Artificial Sequence
  sgRNA
  Rxfp1_16
aaaaattccttattgccaag

SEQ ID NO: 51638 - DNA, 20 bp, Artificial Sequence
  sgRNA
  Rxfp1_17
tctggatgatgcttgccaag

SEQ ID NO: 51639 - DNA, 20 bp, Artificial Sequence
  sgRNA
  Rxfp1_18
cacctgctcatgttcccaca

SEQ ID NO: 51640 - DNA, 20 bp, Artificial Sequence
  sgRNA
  Rxfp1_19
caatgatgataaatgccacc

SEQ ID NO: 51641 - DNA, 20 bp, Artificial Sequence
  sgRNA
  Rxfp1_20
gcggggcatgtgctgacaga

SEQ ID NO: 51642 - DNA, 20 bp, Artificial Sequence
  sgRNA
  Rxfp2_1
caataaagtgacattgacac

SEQ ID NO: 51643 - DNA, 20 bp, Artificial Sequence
  sgRNA
  Rxfp2_2
tctttgacatcaagtaccga

SEQ ID NO: 51644 - DNA, 20 bp, Artificial Sequence
  sgRNA
  Rxfp2_3
tgaggataccgttagccaag

SEQ ID NO: 51645 - DNA, 20 bp, Artificial Sequence
  sgRNA
  Rxfp2_4
aatccacagacttccagtca

SEQ ID NO: 51646 - DNA, 20 bp, Artificial Sequence
  sgRNA
  Rxfp2_5
ggatcttaacgacaaacaca

SEQ ID NO: 51647 - DNA, 20 bp, Artificial Sequence
  sgRNA
  Rxfp2_6
catttggtgagattcccaca

SEQ ID NO: 51648 - DNA, 20 bp, Artificial Sequence
  sgRNA
  Rxfp2_7
cttgatgtcaaagacgccca

SEQ ID NO: 51649 - DNA, 20 bp, Artificial Sequence
  sgRNA
  Rxfp2_8
gcagaagtgaggagccacat

SEQ ID NO: 51650 - DNA, 20 bp, Artificial Sequence
  sgRNA
  Rxfp2_9
gcatttggtgagattcccac

SEQ ID NO: 51651 - DNA, 20 bp, Artificial Sequence
  sgRNA
  Rxfp2_10
tcagatgcctcaactcaact

SEQ ID NO: 51652 - DNA, 20 bp, Artificial Sequence
  sgRNA
  Rxfp2_11
gcttcattatactgtcccca

SEQ ID NO: 51653 - DNA, 20 bp, Artificial Sequence
  sgRNA
  Rxfp2_12
catacttctgatactgccct

SEQ ID NO: 51654 - DNA, 20 bp, Artificial Sequence
  sgRNA
  Rxfp2_13
gcattacctctctcaggcct

SEQ ID NO: 51655 - DNA, 20 bp, Artificial Sequence
  sgRNA
  Rxfp2_14
aggaggtcgtcagagtgtag

SEQ ID NO: 51656 - DNA, 20 bp, Artificial Sequence
  sgRNA
  Rxfp2_15
gtacacccccatcaggcaat

SEQ ID NO: 51657 - DNA, 20 bp, Artificial Sequence
  sgRNA
  Rxfp2_16
gcgatggtgtggatgattgc

SEQ ID NO: 51658 - DNA, 20 bp, Artificial Sequence
  sgRNA
  Rxfp2_17
cctcacttctgcagtctgaa

SEQ ID NO: 51659 - DNA, 20 bp, Artificial Sequence
  sgRNA
  Rxfp2_18
ttaaggcgctgttcaccgga

SEQ ID NO: 51660 - DNA, 20 bp, Artificial Sequence
  sgRNA
  Rxfp2_19
agttgctgcacaaacatcgg

SEQ ID NO: 51661 - DNA, 20 bp, Artificial Sequence
  sgRNA
  Rxfp2_20
gaatatcccaggcctgagag

SEQ ID NO: 51662 - DNA, 20 bp, Artificial Sequence
  sgRNA
  Rxfp4_1
gagtatcgcgcgatactggg

SEQ ID NO: 51663 - DNA, 20 bp, Artificial Sequence
  sgRNA
  Rxfp4_2
ctgtgggttctaggtaactg

SEQ ID NO: 51664 - DNA, 20 bp, Artificial Sequence
  sgRNA
  Rxfp4_3
acaatggcaggacagccgag

SEQ ID NO: 51665 - DNA, 20 bp, Artificial Sequence
  sgRNA
  Rxfp4_4
tgggagcttaccagctacag

SEQ ID NO: 51666 - DNA, 20 bp, Artificial Sequence
  sgRNA
  Rxfp4_5
tcagccccaaagattgctgt

SEQ ID NO: 51667 - DNA, 20 bp, Artificial Sequence
  sgRNA
  Rxfp4_6
gttacctagaacccacagta

SEQ ID NO: 51668 - DNA, 20 bp, Artificial Sequence
  sgRNA
  Rxfp4_7
gtgtagaaagtactgtccca

SEQ ID NO: 51669 - DNA, 20 bp, Artificial Sequence
  sgRNA
  Rxfp4_8
gggcacttccgaaaggccag

SEQ ID NO: 51670 - DNA, 20 bp, Artificial Sequence
  sgRNA
  Rxfp4_9
cacgggcccaaaagactgag

SEQ ID NO: 51671 - DNA, 20 bp, Artificial Sequence
  sgRNA
  Rxfp4_10
gcctggctctagcagacttg

SEQ ID NO: 51672 - DNA, 20 bp, Artificial Sequence
  sgRNA
  Rxfp4_11
gcgatactgggtggtagcca

SEQ ID NO: 51673 - DNA, 20 bp, Artificial Sequence
  sgRNA
  Rxfp4_12
ctggtggtaatgactcccaa

SEQ ID NO: 51674 - DNA, 20 bp, Artificial Sequence
  sgRNA
  Rxfp4_13
gggagcttaccagctacaga

SEQ ID NO: 51675 - DNA, 20 bp, Artificial Sequence
  sgRNA
  Rxfp4_14
tggtcaggactaccttgcag

SEQ ID NO: 51676 - DNA, 20 bp, Artificial Sequence
  sgRNA
  Rxfp4_15
tctttgctgccgctctagaa

SEQ ID NO: 51677 - DNA, 20 bp, Artificial Sequence
  sgRNA
  Rxfp4_16
aatgatacctacaagtccat

SEQ ID NO: 51678 - DNA, 20 bp, Artificial Sequence
  sgRNA
  Rxfp4_17
tttcggaagtgccctctgca

SEQ ID NO: 51679 - DNA, 20 bp, Artificial Sequence
  sgRNA
  Rxfp4_18
ggtcaccctggcagtgtggg

SEQ ID NO: 51680 - DNA, 20 bp, Artificial Sequence
  sgRNA
  Rxfp4_19
ggacagagcgggctaccact

SEQ ID NO: 51681 - DNA, 20 bp, Artificial Sequence
  sgRNA
  Rxfp4_20
cctagaagagccactctcct

SEQ ID NO: 51682 - DNA, 20 bp, Artificial Sequence
  sgRNA
  Ryk_1
actgatgtaaaacacacgcg

SEQ ID NO: 51683 - DNA, 20 bp, Artificial Sequence
  sgRNA
  Ryk_2
tgagcagaaatattgacctg

SEQ ID NO: 51684 - DNA, 20 bp, Artificial Sequence
  sgRNA
  Ryk_3
tgcacacatgagtaatagga

SEQ ID NO: 51685 - DNA, 20 bp, Artificial Sequence
  sgRNA
  Ryk_4
cctcaggttatcctaccttg

SEQ ID NO: 51686 - DNA, 20 bp, Artificial Sequence
  sgRNA
  Ryk_5
gcgccagcagtagttcccag

SEQ ID NO: 51687 - DNA, 20 bp, Artificial Sequence
  sgRNA
  Ryk_6
cctctacctgagcgaggacg

SEQ ID NO: 51688 - DNA, 20 bp, Artificial Sequence
  sgRNA
  Ryk_7
aggtcaatatttctgctcaa

SEQ ID NO: 51689 - DNA, 20 bp, Artificial Sequence
  sgRNA
  Ryk_8
gctcaggtagaggctcacgc

SEQ ID NO: 51690 - DNA, 20 bp, Artificial Sequence
  sgRNA
  Ryk_9
gtcgttcttctctatccgca

SEQ ID NO: 51691 - DNA, 20 bp, Artificial Sequence
  sgRNA
  Ryk_10
tcgttggcgctgcatggaca

SEQ ID NO: 51692 - DNA, 20 bp, Artificial Sequence
  sgRNA
  Ryk_11
agtagaagccaataatccac

SEQ ID NO: 51693 - DNA, 20 bp, Artificial Sequence
  sgRNA
  Ryk_12
tctgggccagacgccctacg

SEQ ID NO: 51694 - DNA, 20 bp, Artificial Sequence
  sgRNA
  Ryk_13
cgtgagcctctacctgagcg

SEQ ID NO: 51695 - DNA, 20 bp, Artificial Sequence
  sgRNA
  Ryk_14
tctcgttgtcccctaggcag

SEQ ID NO: 51696 - DNA, 20 bp, Artificial Sequence
  sgRNA
  Ryk_15
tggctattcagattgcctgc

SEQ ID NO: 51697 - DNA, 20 bp, Artificial Sequence
  sgRNA
  Ryk_16
cctcgtcctcgctcaggtag

SEQ ID NO: 51698 - DNA, 20 bp, Artificial Sequence
  sgRNA
  Ryk_17
ctatggactaccactgccta

SEQ ID NO: 51699 - DNA, 20 bp, Artificial Sequence
  sgRNA
  Ryk_18
aaggggtcgatgtccacgta

SEQ ID NO: 51700 - DNA, 20 bp, Artificial Sequence
  sgRNA
  Ryk_19
tatggactaccactgcctag

SEQ ID NO: 51701 - DNA, 20 bp, Artificial Sequence
  sgRNA
  Ryk_20
ggtaagcggccatctcaaag

SEQ ID NO: 51702 - DNA, 20 bp, Artificial Sequence
  sgRNA
  S1pr1_1
gtccggcattacaactacac

SEQ ID NO: 51703 - DNA, 20 bp, Artificial Sequence
  sgRNA
  S1pr1_2
gcctgctaataggtccgaga

SEQ ID NO: 51704 - DNA, 20 bp, Artificial Sequence
  sgRNA
  S1pr1_3
ctgaagatgaaactacacaa

SEQ ID NO: 51705 - DNA, 20 bp, Artificial Sequence
  sgRNA
  S1pr1_4
ggcaggtgtgagcttgtaag

SEQ ID NO: 51706 - DNA, 20 bp, Artificial Sequence
  sgRNA
  S1pr1_5
cgcctgctaataggtccgag

SEQ ID NO: 51707 - DNA, 20 bp, Artificial Sequence
  sgRNA
  S1pr1_6
gatgtagcgctcaatggcga

SEQ ID NO: 51708 - DNA, 20 bp, Artificial Sequence
  sgRNA
  S1pr1_7
tgtaagccacgcctgctaat

SEQ ID NO: 51709 - DNA, 20 bp, Artificial Sequence
  sgRNA
  S1pr1_8
gccctctcggacctattagc

SEQ ID NO: 51710 - DNA, 20 bp, Artificial Sequence
  sgRNA
  S1pr1_9
ggaaaaccaagaagttccac

SEQ ID NO: 51711 - DNA, 20 bp, Artificial Sequence
  sgRNA
  S1pr1_10
ggaagtactctgctttgtac

SEQ ID NO: 51712 - DNA, 20 bp, Artificial Sequence
  sgRNA
  S1pr1_11
ttgccagcagagtctccgtt

SEQ ID NO: 51713 - DNA, 20 bp, Artificial Sequence
  sgRNA
  S1pr1_12
cccttcccgcagaaaccact

SEQ ID NO: 51714 - DNA, 20 bp, Artificial Sequence
  sgRNA
  S1pr1_13
tcttgcggaaggtcaggcgg

SEQ ID NO: 51715 - DNA, 20 bp, Artificial Sequence
  sgRNA
  S1pr1_14
cctgcagtagaggatgacga

SEQ ID NO: 51716 - DNA, 20 bp, Artificial Sequence
  sgRNA
  S1pr1_15
catagtcagagactgagctg

SEQ ID NO: 51717 - DNA, 20 bp, Artificial Sequence
  sgRNA
  S1pr1_16
gatgagggagatgacccagc

SEQ ID NO: 51718 - DNA, 20 bp, Artificial Sequence
  sgRNA
  S1pr1_17
tcttgttgcaaatgccccaa

SEQ ID NO: 51719 - DNA, 20 bp, Artificial Sequence
  sgRNA
  S1pr1_18
ggtcatctccctcatcctgg

SEQ ID NO: 51720 - DNA, 20 bp, Artificial Sequence
  sgRNA
  S1pr1_19
cttgtggtagagcgggagca

SEQ ID NO: 51721 - DNA, 20 bp, Artificial Sequence
  sgRNA
  S1pr1_20
ggaactatgatatcatagtc

SEQ ID NO: 51722 - DNA, 20 bp, Artificial Sequence
  sgRNA
  S1pr2_1
aatcagcgatatcagccaag

SEQ ID NO: 51723 - DNA, 20 bp, Artificial Sequence
  sgRNA
  S1pr2_2
catcgccatcgagagacaag

SEQ ID NO: 51724 - DNA, 20 bp, Artificial Sequence
  sgRNA
  S1pr2_3
ggaacactacaattacacca

SEQ ID NO: 51725 - DNA, 20 bp, Artificial Sequence
  sgRNA
  S1pr2_4
cagaagattctccaccacga

SEQ ID NO: 51726 - DNA, 20 bp, Artificial Sequence
  sgRNA
  S1pr2_5
tgtagtccgctccagccacg

SEQ ID NO: 51727 - DNA, 20 bp, Artificial Sequence
  sgRNA
  S1pr2_6
gaggaccagcaacatccgcg

SEQ ID NO: 51728 - DNA, 20 bp, Artificial Sequence
  sgRNA
  S1pr2_7
tcaatcctgtcatctatacg

SEQ ID NO: 51729 - DNA, 20 bp, Artificial Sequence
  sgRNA
  S1pr2_8
taagcactacgtgctctgcg

SEQ ID NO: 51730 - DNA, 20 bp, Artificial Sequence
  sgRNA
  S1pr2_9
ctacgccacgtatagatgac

SEQ ID NO: 51731 - DNA, 20 bp, Artificial Sequence
  sgRNA
  S1pr2_10
acatcaccgacatttctgga

SEQ ID NO: 51732 - DNA, 20 bp, Artificial Sequence
  sgRNA
  S1pr2_11
gatgaaaacacccagtacga

SEQ ID NO: 51733 - DNA, 20 bp, Artificial Sequence
  sgRNA
  S1pr2_12
gcagcctctgacctgctggc

SEQ ID NO: 51734 - DNA, 20 bp, Artificial Sequence
  sgRNA
  S1pr2_13
ccgaatgctgatgctcatcg

SEQ ID NO: 51735 - DNA, 20 bp, Artificial Sequence
  sgRNA
  S1pr2_14
gcgtagccgggaccttcgga

SEQ ID NO: 51736 - DNA, 20 bp, Artificial Sequence
  sgRNA
  S1pr2_15
gacgctagccctgctcaaga

SEQ ID NO: 51737 - DNA, 20 bp, Artificial Sequence
  sgRNA
  S1pr2_16
cttgtgctgcgccatcgtgg

SEQ ID NO: 51738 - DNA, 20 bp, Artificial Sequence
  sgRNA
  S1pr2_17
gtgttaccctccagaaatgt

SEQ ID NO: 51739 - DNA, 20 bp, Artificial Sequence
  sgRNA
  S1pr2_18
gaattgtctgaaccagctgg

SEQ ID NO: 51740 - DNA, 20 bp, Artificial Sequence
  sgRNA
  S1pr2_19
gagacaagtggccctcgcca

SEQ ID NO: 51741 - DNA, 20 bp, Artificial Sequence
  sgRNA
  S1pr2_20
cctctccgccagcactgcag

SEQ ID NO: 51742 - DNA, 20 bp, Artificial Sequence
  sgRNA
  S1pr3_1
gggaacattacgattacgtg

SEQ ID NO: 51743 - DNA, 20 bp, Artificial Sequence
  sgRNA
  S1pr3_2
aatcactacggtccgcagaa

SEQ ID NO: 51744 - DNA, 20 bp, Artificial Sequence
  sgRNA
  S1pr3_3
gccagcacatcccaatcaga

SEQ ID NO: 51745 - DNA, 20 bp, Artificial Sequence
  sgRNA
  S1pr3_4
gcgcgcatacaagatgacga

SEQ ID NO: 51746 - DNA, 20 bp, Artificial Sequence
  sgRNA
  S1pr3_5
tgtatgctatgccggccagc

SEQ ID NO: 51747 - DNA, 20 bp, Artificial Sequence
  sgRNA
  S1pr3_6
tcaatattcttatgtccggc

SEQ ID NO: 51748 - DNA, 20 bp, Artificial Sequence
  sgRNA
  S1pr3_7
ggtcaagtccagcagccgca

SEQ ID NO: 51749 - DNA, 20 bp, Artificial Sequence
  sgRNA
  S1pr3_8
gtatgcgcgcatctactgcc

SEQ ID NO: 51750 - DNA, 20 bp, Artificial Sequence
  sgRNA
  S1pr3_9
ctagacagccgcacaccaac

SEQ ID NO: 51751 - DNA, 20 bp, Artificial Sequence
  sgRNA
  S1pr3_10
caggaagaagtagccacgcg

SEQ ID NO: 51752 - DNA, 20 bp, Artificial Sequence
  sgRNA
  S1pr3_11
agttgtggttggccaccctg

SEQ ID NO: 51753 - DNA, 20 bp, Artificial Sequence
  sgRNA
  S1pr3_12
tgaaccactgactcttgaag

SEQ ID NO: 51754 - DNA, 20 bp, Artificial Sequence
  sgRNA
  S1pr3_13
ccgggaacattacgattacg

SEQ ID NO: 51755 - DNA, 20 bp, Artificial Sequence
  sgRNA
  S1pr3_14
ccacaactctgagagatcca

SEQ ID NO: 51756 - DNA, 20 bp, Artificial Sequence
  sgRNA
  S1pr3_15
gttccagcccaggattggca

SEQ ID NO: 51757 - DNA, 20 bp, Artificial Sequence
  sgRNA
  S1pr3_16
gaggcgcgccttcttccggt

SEQ ID NO: 51758 - DNA, 20 bp, Artificial Sequence
  sgRNA
  S1pr3_17
gacgatggtcaccagaatgg

SEQ ID NO: 51759 - DNA, 20 bp, Artificial Sequence
  sgRNA
  S1pr3_18
ggatctctcagagttgtggt

SEQ ID NO: 51760 - DNA, 20 bp, Artificial Sequence
  sgRNA
  S1pr3_19
cacactcaccacaatcacta

SEQ ID NO: 51761 - DNA, 20 bp, Artificial Sequence
  sgRNA
  S1pr3_20
tcagtctgtctccaacagtg

SEQ ID NO: 51762 - DNA, 20 bp, Artificial Sequence
  sgRNA
  S1pr4_1
cagcagcacgttgaccacgt

SEQ ID NO: 51763 - DNA, 20 bp, Artificial Sequence
  sgRNA
  S1pr4_2
acatagcccttggagtagag

SEQ ID NO: 51764 - DNA, 20 bp, Artificial Sequence
  sgRNA
  S1pr4_3
gattgtagtgcaggacaatg

SEQ ID NO: 51765 - DNA, 20 bp, Artificial Sequence
  sgRNA
  S1pr4_4
ctctaaagatggccccgtag

SEQ ID NO: 51766 - DNA, 20 bp, Artificial Sequence
  sgRNA
  S1pr4_5
ggctatcctgagcctctacg

SEQ ID NO: 51767 - DNA, 20 bp, Artificial Sequence
  sgRNA
  S1pr4_6
gcaggcagtagtacacccag

SEQ ID NO: 51768 - DNA, 20 bp, Artificial Sequence
  sgRNA
  S1pr4_7
ggtcttcgccctcatcctag

SEQ ID NO: 51769 - DNA, 20 bp, Artificial Sequence
  sgRNA
  S1pr4_8
gaccgatgcagccatacaca

SEQ ID NO: 51770 - DNA, 20 bp, Artificial Sequence
  sgRNA
  S1pr4_9
ctactccttccgcagccgtg

SEQ ID NO: 51771 - DNA, 20 bp, Artificial Sequence
  sgRNA
  S1pr4_10
catggtggcgaagcgctcgc

SEQ ID NO: 51772 - DNA, 20 bp, Artificial Sequence
  sgRNA
  S1pr4_11
gtagcctgcgggacttgcgg

SEQ ID NO: 51773 - DNA, 20 bp, Artificial Sequence
  sgRNA
  S1pr4_12
tgaagagcaggccctcccgc

SEQ ID NO: 51774 - DNA, 20 bp, Artificial Sequence
  sgRNA
  S1pr4_13
ggctgagttgaacacggcca

SEQ ID NO: 51775 - DNA, 20 bp, Artificial Sequence
  sgRNA
  S1pr4_14
ccgccatcgccatctacatg

SEQ ID NO: 51776 - DNA, 20 bp, Artificial Sequence
  sgRNA
  S1pr4_15
gcagtagtacacccagcggc

SEQ ID NO: 51777 - DNA, 20 bp, Artificial Sequence
  sgRNA
  S1pr4_16
gatgcagccatacacacggc

SEQ ID NO: 51778 - DNA, 20 bp, Artificial Sequence
  sgRNA
  S1pr4_17
gcacggtgttgagtagcctg

SEQ ID NO: 51779 - DNA, 20 bp, Artificial Sequence
  sgRNA
  S1pr4_18
ggaccgcatgtagatggcga

SEQ ID NO: 51780 - DNA, 20 bp, Artificial Sequence
  sgRNA
  S1pr4_19
gcacagcgcgctgcacctca

SEQ ID NO: 51781 - DNA, 20 bp, Artificial Sequence
  sgRNA
  S1pr4_20
ctacatgcggtcccgccgct

SEQ ID NO: 51782 - DNA, 20 bp, Artificial Sequence
  sgRNA
  S1pr5_1
cctgcttcgtacccttagcg

SEQ ID NO: 51783 - DNA, 20 bp, Artificial Sequence
  sgRNA
  S1pr5_2
caccttaccatggcccgtcg

SEQ ID NO: 51784 - DNA, 20 bp, Artificial Sequence
  sgRNA
  S1pr5_3
caaggatttactgtcaggtg

SEQ ID NO: 51785 - DNA, 20 bp, Artificial Sequence
  sgRNA
  S1pr5_4
gtccttcactacaactacac

SEQ ID NO: 51786 - DNA, 20 bp, Artificial Sequence
  sgRNA
  S1pr5_5
ctacaccggcaagctccgcg

SEQ ID NO: 51787 - DNA, 20 bp, Artificial Sequence
  sgRNA
  S1pr5_6
ccttgcatagagcgcacaga

SEQ ID NO: 51788 - DNA, 20 bp, Artificial Sequence
  sgRNA
  S1pr5_7
agttagccatggctagaccc

SEQ ID NO: 51789 - DNA, 20 bp, Artificial Sequence
  sgRNA
  S1pr5_8
acataggccttggcgtagag

SEQ ID NO: 51790 - DNA, 20 bp, Artificial Sequence
  sgRNA
  S1pr5_9
actttgtcggacctgctcgc

SEQ ID NO: 51791 - DNA, 20 bp, Artificial Sequence
  sgRNA
  S1pr5_10
tttagagcgccaccttacca

SEQ ID NO: 51792 - DNA, 20 bp, Artificial Sequence
  sgRNA
  S1pr5_11
caagaggctcagcaccgacg

SEQ ID NO: 51793 - DNA, 20 bp, Artificial Sequence
  sgRNA
  S1pr5_12
agtcttggttgcagggtccg

SEQ ID NO: 51794 - DNA, 20 bp, Artificial Sequence
  sgRNA
  S1pr5_13
aggacaataacctcactcac

SEQ ID NO: 51795 - DNA, 20 bp, Artificial Sequence
  sgRNA
  S1pr5_14
acatgggcgcatggaagcga

SEQ ID NO: 51796 - DNA, 20 bp, Artificial Sequence
  sgRNA
  S1pr5_15
ataacctcactcaccggcgc

SEQ ID NO: 51797 - DNA, 20 bp, Artificial Sequence
  sgRNA
  S1pr5_16
cttggcgtagagcggcagca

SEQ ID NO: 51798 - DNA, 20 bp, Artificial Sequence
  sgRNA
  S1pr5_17
tcacgcgcaaaccaaagcgc

SEQ ID NO: 51799 - DNA, 20 bp, Artificial Sequence
  sgRNA
  S1pr5_18
agtaggcaccaggctccggt

SEQ ID NO: 51800 - DNA, 20 bp, Artificial Sequence
  sgRNA
  S1pr5_19
attcagcagcgagttagcca

SEQ ID NO: 51801 - DNA, 20 bp, Artificial Sequence
  sgRNA
  S1pr5_20
ctatgcaaggatttactgtc

SEQ ID NO: 51802 - DNA, 20 bp, Artificial Sequence
  sgRNA
  Scap_1
ctgttggatgtacgccacgg

SEQ ID NO: 51803 - DNA, 20 bp, Artificial Sequence
  sgRNA
  Scap_2
atgatgtaggtggtcacgag

SEQ ID NO: 51804 - DNA, 20 bp, Artificial Sequence
  sgRNA
  Scap_3
ccttaggtccggactcccag

SEQ ID NO: 51805 - DNA, 20 bp, Artificial Sequence
  sgRNA
  Scap_4
gcgtagccgtagtcatcgca

SEQ ID NO: 51806 - DNA, 20 bp, Artificial Sequence
  sgRNA
  Scap_5
aggcactgcgaccatcctga

SEQ ID NO: 51807 - DNA, 20 bp, Artificial Sequence
  sgRNA
  Scap_6
tctgttggatgtacgccacg

SEQ ID NO: 51808 - DNA, 20 bp, Artificial Sequence
  sgRNA
  Scap_7
cccggctgcccataattacg

SEQ ID NO: 51809 - DNA, 20 bp, Artificial Sequence
  sgRNA
  Scap_8
gataaccttctggtgaccgg

SEQ ID NO: 51810 - DNA, 20 bp, Artificial Sequence
  sgRNA
  Scap_9
ggcaacacgagtcatccagt

SEQ ID NO: 51811 - DNA, 20 bp, Artificial Sequence
  sgRNA
  Scap_10
cgtaattatgggcagccggg

SEQ ID NO: 51812 - DNA, 20 bp, Artificial Sequence
  sgRNA
  Scap_11
ctagcccaataacgaccacc

SEQ ID NO: 51813 - DNA, 20 bp, Artificial Sequence
  sgRNA
  Scap_12
gcttcctgtgtcattagtag

SEQ ID NO: 51814 - DNA, 20 bp, Artificial Sequence
  sgRNA
  Scap_13
gtcgatcgacattcgccgga

SEQ ID NO: 51815 - DNA, 20 bp, Artificial Sequence
  sgRNA
  Scap_14
tcgagtgtctggctagcgat

SEQ ID NO: 51816 - DNA, 20 bp, Artificial Sequence
  sgRNA
  Scap_15
cataacccgagtctctagag

SEQ ID NO: 51817 - DNA, 20 bp, Artificial Sequence
  sgRNA
  Scap_16
tctgtcccgagcattccaac

SEQ ID NO: 51818 - DNA, 20 bp, Artificial Sequence
  sgRNA
  Scap_17
tggtatacaccgacccggca

SEQ ID NO: 51819 - DNA, 20 bp, Artificial Sequence
  sgRNA
  Scap_18
gctactagtgagctgctgcc

SEQ ID NO: 51820 - DNA, 20 bp, Artificial Sequence
  sgRNA
  Scap_19
gcaacacagtgacctgtcat

SEQ ID NO: 51821 - DNA, 20 bp, Artificial Sequence
  sgRNA
  Scap_20
tgagggaggtaacatctcca

SEQ ID NO: 51822 - DNA, 20 bp, Artificial Sequence
  sgRNA
  Scara5_1
taggtccatgtcacaaacgg

SEQ ID NO: 51823 - DNA, 20 bp, Artificial Sequence
  sgRNA
  Scara5_2
ctggtagagttccagctgtg

SEQ ID NO: 51824 - DNA, 20 bp, Artificial Sequence
  sgRNA
  Scara5_3
cagcgccttcaagtcatctg

SEQ ID NO: 51825 - DNA, 20 bp, Artificial Sequence
  sgRNA
  Scara5_4
gggaacactccatcgccttg

SEQ ID NO: 51826 - DNA, 20 bp, Artificial Sequence
  sgRNA
  Scara5_5
ggtacacctcctcaaccccg

SEQ ID NO: 51827 - DNA, 20 bp, Artificial Sequence
  sgRNA
  Scara5_6
accgtgagtgaccgtgacaa

SEQ ID NO: 51828 - DNA, 20 bp, Artificial Sequence
  sgRNA
  Scara5_7
ttgaatccgcgcatgcccat

SEQ ID NO: 51829 - DNA, 20 bp, Artificial Sequence
  sgRNA
  Scara5_8
tggtcacctttgggtcccgg

SEQ ID NO: 51830 - DNA, 20 bp, Artificial Sequence
  sgRNA
  Scara5_9
cgctgactcggaacgtcaac

SEQ ID NO: 51831 - DNA, 20 bp, Artificial Sequence
  sgRNA
  Scara5_10
aatggctccggcccacacca

SEQ ID NO: 51832 - DNA, 20 bp, Artificial Sequence
  sgRNA
  Scara5_11
gcgcagacactcgccgtatg

SEQ ID NO: 51833 - DNA, 20 bp, Artificial Sequence
  sgRNA
  Scara5_12
tccatgtcacaaacggcggg

SEQ ID NO: 51834 - DNA, 20 bp, Artificial Sequence
  sgRNA
  Scara5_13
gtccaagctgaacctgtgtg

SEQ ID NO: 51835 - DNA, 20 bp, Artificial Sequence
  sgRNA
  Scara5_14
gccgcagctgcatgtcccgg

SEQ ID NO: 51836 - DNA, 20 bp, Artificial Sequence
  sgRNA
  Scara5_15
gctactgctgcagcgccacg

SEQ ID NO: 51837 - DNA, 20 bp, Artificial Sequence
  sgRNA
  Scara5_16
ccgcatgctgggcttccacg

SEQ ID NO: 51838 - DNA, 20 bp, Artificial Sequence
  sgRNA
  Scara5_17
tgcgtgctagcccatccagc

SEQ ID NO: 51839 - DNA, 20 bp, Artificial Sequence
  sgRNA
  Scara5_18
ctaggggctacgggccccat

SEQ ID NO: 51840 - DNA, 20 bp, Artificial Sequence
  sgRNA
  Scara5_19
ggagctggccacactcaacg

SEQ ID NO: 51841 - DNA, 20 bp, Artificial Sequence
  sgRNA
  Scara5_20
ggcttggtgcagaggctgga

SEQ ID NO: 51842 - DNA, 20 bp, Artificial Sequence
  sgRNA
  Scarb1_1
ggggccgtgaagcgatacgt

SEQ ID NO: 51843 - DNA, 20 bp, Artificial Sequence
  sgRNA
  Scarb1_2
tgcggttcataaaagcacgc

SEQ ID NO: 51844 - DNA, 20 bp, Artificial Sequence
  sgRNA
  Scarb1_3
gatgaacaactcgaattctg

SEQ ID NO: 51845 - DNA, 20 bp, Artificial Sequence
  sgRNA
  Scarb1_4
gaggattcgggtgtcatgaa

SEQ ID NO: 51846 - DNA, 20 bp, Artificial Sequence
  sgRNA
  Scarb1_5
ggtcggcgttgtaaaagtgg

SEQ ID NO: 51847 - DNA, 20 bp, Artificial Sequence
  sgRNA
  Scarb1_6
gctgacctacaacgaatcaa

SEQ ID NO: 51848 - DNA, 20 bp, Artificial Sequence
  sgRNA
  Scarb1_7
gcggttctccacgaaggaca

SEQ ID NO: 51849 - DNA, 20 bp, Artificial Sequence
  sgRNA
  Scarb1_8
tcttctgcagagcggagcaa

SEQ ID NO: 51850 - DNA, 20 bp, Artificial Sequence
  sgRNA
  Scarb1_9
gggtcggcgttgtaaaagtg

SEQ ID NO: 51851 - DNA, 20 bp, Artificial Sequence
  sgRNA
  Scarb1_10
gctggaattcttcagcccgg

SEQ ID NO: 51852 - DNA, 20 bp, Artificial Sequence
  sgRNA
  Scarb1_11
gttggcaaacagagtatcgg

SEQ ID NO: 51853 - DNA, 20 bp, Artificial Sequence
  sgRNA
  Scarb1_12
gggggccgtgaagcgatacg

SEQ ID NO: 51854 - DNA, 20 bp, Artificial Sequence
  sgRNA
  Scarb1_13
acaggatctcaccaactgtg

SEQ ID NO: 51855 - DNA, 20 bp, Artificial Sequence
  sgRNA
  Scarb1_14
ccatcaatatcgagcccccc

SEQ ID NO: 51856 - DNA, 20 bp, Artificial Sequence
  sgRNA
  Scarb1_15
ttccagcctgacaagtcgca

SEQ ID NO: 51857 - DNA, 20 bp, Artificial Sequence
  sgRNA
  Scarb1_16
tggtctgaaccctaacccaa

SEQ ID NO: 51858 - DNA, 20 bp, Artificial Sequence
  sgRNA
  Scarb1_17
gatctccttccacatcccga

SEQ ID NO: 51859 - DNA, 20 bp, Artificial Sequence
  sgRNA
  Scarb1_18
cgggctgaagaattccagcg

SEQ ID NO: 51860 - DNA, 20 bp, Artificial Sequence
  sgRNA
  Scarb1_19
ggccgttgaggacctcgttt

SEQ ID NO: 51861 - DNA, 20 bp, Artificial Sequence
  sgRNA
  Scarb1_20
agtagacagacaagtagaaa

SEQ ID NO: 51862 - DNA, 20 bp, Artificial Sequence
  sgRNA
  Scarb2_1
atagaacaggccgaaattcg

SEQ ID NO: 51863 - DNA, 20 bp, Artificial Sequence
  sgRNA
  Scarb2_2
aaataaaactggatgtacac

SEQ ID NO: 51864 - DNA, 20 bp, Artificial Sequence
  sgRNA
  Scarb2_3
aatatgattaacgggacaga

SEQ ID NO: 51865 - DNA, 20 bp, Artificial Sequence
  sgRNA
  Scarb2_4
ataatgacacgtaccaacag

SEQ ID NO: 51866 - DNA, 20 bp, Artificial Sequence
  sgRNA
  Scarb2_5
gctggcttctgtatacccga

SEQ ID NO: 51867 - DNA, 20 bp, Artificial Sequence
  sgRNA
  Scarb2_6
gatgctgcttctacacggcg

SEQ ID NO: 51868 - DNA, 20 bp, Artificial Sequence
  sgRNA
  Scarb2_7
cgtcggcttggtaaaagtgt

SEQ ID NO: 51869 - DNA, 20 bp, Artificial Sequence
  sgRNA
  Scarb2_8
ggcaccttataccgaaaagc

SEQ ID NO: 51870 - DNA, 20 bp, Artificial Sequence
  sgRNA
  Scarb2_9
gagtccatgcagtttccctc

SEQ ID NO: 51871 - DNA, 20 bp, Artificial Sequence
  sgRNA
  Scarb2_10
ggcagaaacgaacttctcgt

SEQ ID NO: 51872 - DNA, 20 bp, Artificial Sequence
  sgRNA
  Scarb2_11
gccaacacctccgaaaacgc

SEQ ID NO: 51873 - DNA, 20 bp, Artificial Sequence
  sgRNA
  Scarb2_12
gttctaatcaagtcaacgtt

SEQ ID NO: 51874 - DNA, 20 bp, Artificial Sequence
  sgRNA
  Scarb2_13
aatcctgaggagatcctcca

SEQ ID NO: 51875 - DNA, 20 bp, Artificial Sequence
  sgRNA
  Scarb2_14
tatacccgagggaaactgca

SEQ ID NO: 51876 - DNA, 20 bp, Artificial Sequence
  sgRNA
  Scarb2_15
ggctcgagtctttcagaagg

SEQ ID NO: 51877 - DNA, 20 bp, Artificial Sequence
  sgRNA
  Scarb2_16
ctgctgataggctttcagca

SEQ ID NO: 51878 - DNA, 20 bp, Artificial Sequence
  sgRNA
  Scarb2_17
agagaaatggaacgaatgac

SEQ ID NO: 51879 - DNA, 20 bp, Artificial Sequence
  sgRNA
  Scarb2_18
gagaaatggaacgaatgacg

SEQ ID NO: 51880 - DNA, 20 bp, Artificial Sequence
  sgRNA
  Scarb2_19
acctcatccttgcttatcag

SEQ ID NO: 51881 - DNA, 20 bp, Artificial Sequence
  sgRNA
  Scarb2_20
ggtattacaaaatggcacca

SEQ ID NO: 51882 - DNA, 20 bp, Artificial Sequence
  sgRNA
  Scarf1_1
agtttctcatcacgatccag

SEQ ID NO: 51883 - DNA, 20 bp, Artificial Sequence
  sgRNA
  Scarf1_2
atccaggtttacaccgacag

SEQ ID NO: 51884 - DNA, 20 bp, Artificial Sequence
  sgRNA
  Scarf1_3
tgagggcgttcttaccatga

SEQ ID NO: 51885 - DNA, 20 bp, Artificial Sequence
  sgRNA
  Scarf1_4
tggcacttacgactgcactc

SEQ ID NO: 51886 - DNA, 20 bp, Artificial Sequence
  sgRNA
  Scarf1_5
agtcacggccaacttccacc

SEQ ID NO: 51887 - DNA, 20 bp, Artificial Sequence
  sgRNA
  Scarf1_6
gctaccatctggctaccagg

SEQ ID NO: 51888 - DNA, 20 bp, Artificial Sequence
  sgRNA
  Scarf1_7
gcatagagcagttgtttccg

SEQ ID NO: 51889 - DNA, 20 bp, Artificial Sequence
  sgRNA
  Scarf1_8
tggccagtgcgaaccggcca

SEQ ID NO: 51890 - DNA, 20 bp, Artificial Sequence
  sgRNA
  Scarf1_9
ggagtcctgcatgcagggcg

SEQ ID NO: 51891 - DNA, 20 bp, Artificial Sequence
  sgRNA
  Scarf1_10
gcacctctggagagtctctt

SEQ ID NO: 51892 - DNA, 20 bp, Artificial Sequence
  sgRNA
  Scarf1_11
tatgccctgccaatgcccag

SEQ ID NO: 51893 - DNA, 20 bp, Artificial Sequence
  sgRNA
  Scarf1_12
ggttgcaaggcagctcacag

SEQ ID NO: 51894 - DNA, 20 bp, Artificial Sequence
  sgRNA
  Scarf1_13
ggaacctgtgtatgcccgcc

SEQ ID NO: 51895 - DNA, 20 bp, Artificial Sequence
  sgRNA
  Scarf1_14
gggacacctcagaaacctga

SEQ ID NO: 51896 - DNA, 20 bp, Artificial Sequence
  sgRNA
  Scarf1_15
cctggttccgacccagagat

SEQ ID NO: 51897 - DNA, 20 bp, Artificial Sequence
  sgRNA
  Scarf1_16
acttccacctggtagccaga

SEQ ID NO: 51898 - DNA, 20 bp, Artificial Sequence
  sgRNA
  Scarf1_17
ggcacaacattctcatacag

SEQ ID NO: 51899 - DNA, 20 bp, Artificial Sequence
  sgRNA
  Scarf1_18
tgtttcctctggtctaactg

SEQ ID NO: 51900 - DNA, 20 bp, Artificial Sequence
  sgRNA
  Scarf1_19
ctgctgctcaggaacccgac

SEQ ID NO: 51901 - DNA, 20 bp, Artificial Sequence
  sgRNA
  Scarf1_20
acgtgggtgaccaccagcca

SEQ ID NO: 51902 - DNA, 20 bp, Artificial Sequence
  sgRNA
  Scarf2_1
tcacgaggaatcatgcgacc

SEQ ID NO: 51903 - DNA, 20 bp, Artificial Sequence
  sgRNA
  Scarf2_2
cagtaatggcacttacggtg

SEQ ID NO: 51904 - DNA, 20 bp, Artificial Sequence
  sgRNA
  Scarf2_3
cggccttcgactaccgtgca

SEQ ID NO: 51905 - DNA, 20 bp, Artificial Sequence
  sgRNA
  Scarf2_4
cacacgtgccgtccaccggg

SEQ ID NO: 51906 - DNA, 20 bp, Artificial Sequence
  sgRNA
  Scarf2_5
tcacggtcgctgccacccgg

SEQ ID NO: 51907 - DNA, 20 bp, Artificial Sequence
  sgRNA
  Scarf2_6
gctcgcgacaatacttgccc

SEQ ID NO: 51908 - DNA, 20 bp, Artificial Sequence
  sgRNA
  Scarf2_7
gctctcggagccaacggacg

SEQ ID NO: 51909 - DNA, 20 bp, Artificial Sequence
  sgRNA
  Scarf2_8
ccacccgcacggacagtgcg

SEQ ID NO: 51910 - DNA, 20 bp, Artificial Sequence
  sgRNA
  Scarf2_9
tcaagcgtggaggggccgag

SEQ ID NO: 51911 - DNA, 20 bp, Artificial Sequence
  sgRNA
  Scarf2_10
tgcgctcgcgacactggcag

SEQ ID NO: 51912 - DNA, 20 bp, Artificial Sequence
  sgRNA
  Scarf2_11
gcccgggccatagaatccag

SEQ ID NO: 51913 - DNA, 20 bp, Artificial Sequence
  sgRNA
  Scarf2_12
cgagcgctccgcatcaagcg

SEQ ID NO: 51914 - DNA, 20 bp, Artificial Sequence
  sgRNA
  Scarf2_13
ccgtagaaaccggtggcgca

SEQ ID NO: 51915 - DNA, 20 bp, Artificial Sequence
  sgRNA
  Scarf2_14
gctccgcatcaagcgtggag

SEQ ID NO: 51916 - DNA, 20 bp, Artificial Sequence
  sgRNA
  Scarf2_15
aggtgcagttgccacccgca

SEQ ID NO: 51917 - DNA, 20 bp, Artificial Sequence
  sgRNA
  Scarf2_16
tgtgtactgtgtgccccacg

SEQ ID NO: 51918 - DNA, 20 bp, Artificial Sequence
  sgRNA
  Scarf2_17
accttcgccgtagaaaccgg

SEQ ID NO: 51919 - DNA, 20 bp, Artificial Sequence
  sgRNA
  Scarf2_18
gccgcaatcagagcacacga

SEQ ID NO: 51920 - DNA, 20 bp, Artificial Sequence
  sgRNA
  Scarf2_19
gccaccggtttctacggcga

SEQ ID NO: 51921 - DNA, 20 bp, Artificial Sequence
  sgRNA
  Scarf2_20
gcgctccgcatcaagcgtgg

SEQ ID NO: 51922 - DNA, 20 bp, Artificial Sequence
  sgRNA
  Scn10a_1
caagagaagacgttaccaag

SEQ ID NO: 51923 - DNA, 20 bp, Artificial Sequence
  sgRNA
  Scn10a_2
gatccattgccacacaacaa

SEQ ID NO: 51924 - DNA, 20 bp, Artificial Sequence
  sgRNA
  Scn10a_3
ccagcaatatggaacttcga

SEQ ID NO: 51925 - DNA, 20 bp, Artificial Sequence
  sgRNA
  Scn10a_4
catcactgatcctaacgtgt

SEQ ID NO: 51926 - DNA, 20 bp, Artificial Sequence
  sgRNA
  Scn10a_5
tccgttgtgggaatagagcg

SEQ ID NO: 51927 - DNA, 20 bp, Artificial Sequence
  sgRNA
  Scn10a_6
ggacctggctccatacctgg

SEQ ID NO: 51928 - DNA, 20 bp, Artificial Sequence
  sgRNA
  Scn10a_7
gagggcacggagagtccgaa

SEQ ID NO: 51929 - DNA, 20 bp, Artificial Sequence
  sgRNA
  Scn10a_8
agagaactatgggtgccgca

SEQ ID NO: 51930 - DNA, 20 bp, Artificial Sequence
  sgRNA
  Scn10a_9
gatcctcgagtattcagacg

SEQ ID NO: 51931 - DNA, 20 bp, Artificial Sequence
  sgRNA
  Scn10a_10
acacggagatgccatccctg

SEQ ID NO: 51932 - DNA, 20 bp, Artificial Sequence
  sgRNA
  Scn10a_11
ccagctttgattccttcgcg

SEQ ID NO: 51933 - DNA, 20 bp, Artificial Sequence
  sgRNA
  Scn10a_12
ggatggcgtgtcactcccca

SEQ ID NO: 51934 - DNA, 20 bp, Artificial Sequence
  sgRNA
  Scn10a_13
ggagaccgacaatcagagcg

SEQ ID NO: 51935 - DNA, 20 bp, Artificial Sequence
  sgRNA
  Scn10a_14
cagcctctcaccattccaca

SEQ ID NO: 51936 - DNA, 20 bp, Artificial Sequence
  sgRNA
  Scn10a_15
ggtgcagcgatagacctccg

SEQ ID NO: 51937 - DNA, 20 bp, Artificial Sequence
  sgRNA
  Scn10a_16
tggctgctcgaatcagcctg

SEQ ID NO: 51938 - DNA, 20 bp, Artificial Sequence
  sgRNA
  Scn10a_17
gggagctcgccatagaacct

SEQ ID NO: 51939 - DNA, 20 bp, Artificial Sequence
  sgRNA
  Scn10a_18
tggcgtccatcaaagccctt

SEQ ID NO: 51940 - DNA, 20 bp, Artificial Sequence
  sgRNA
  Scn10a_19
gctaagctgatcaagcaggg

SEQ ID NO: 51941 - DNA, 20 bp, Artificial Sequence
  sgRNA
  Scn10a_20
ggtgaagtaatactgccgaa

SEQ ID NO: 51942 - DNA, 20 bp, Artificial Sequence
  sgRNA
  Scn11a_1
tattgcacgtggaaccatcg

SEQ ID NO: 51943 - DNA, 20 bp, Artificial Sequence
  sgRNA
  Scn11a_2
gaggacgatatggaatgttg

SEQ ID NO: 51944 - DNA, 20 bp, Artificial Sequence
  sgRNA
  Scn11a_3
tttgtttgctcaaggagttg

SEQ ID NO: 51945 - DNA, 20 bp, Artificial Sequence
  sgRNA
  Scn11a_4
cttaatgagagtgtttaatg

SEQ ID NO: 51946 - DNA, 20 bp, Artificial Sequence
  sgRNA
  Scn11a_5
ctacctgcttaacttaaccc

SEQ ID NO: 51947 - DNA, 20 bp, Artificial Sequence
  sgRNA
  Scn11a_6
tctttatgcacagccacgga

SEQ ID NO: 51948 - DNA, 20 bp, Artificial Sequence
  sgRNA
  Scn11a_7
ttcgaccgatccgagccaag

SEQ ID NO: 51949 - DNA, 20 bp, Artificial Sequence
  sgRNA
  Scn11a_8
aatcctcagactggtccggg

SEQ ID NO: 51950 - DNA, 20 bp, Artificial Sequence
  sgRNA
  Scn11a_9
cagcgctcgcagattccgga

SEQ ID NO: 51951 - DNA, 20 bp, Artificial Sequence
  sgRNA
  Scn11a_10
cagtgatcttcccagacgag

SEQ ID NO: 51952 - DNA, 20 bp, Artificial Sequence
  sgRNA
  Scn11a_11
gtagctgacgaagtagacta

SEQ ID NO: 51953 - DNA, 20 bp, Artificial Sequence
  sgRNA
  Scn11a_12
cgctcggctgaaccgatcca

SEQ ID NO: 51954 - DNA, 20 bp, Artificial Sequence
  sgRNA
  Scn11a_13
gaagcggatcaccatccaaa

SEQ ID NO: 51955 - DNA, 20 bp, Artificial Sequence
  sgRNA
  Scn11a_14
ccattgtcaccaccacaaag

SEQ ID NO: 51956 - DNA, 20 bp, Artificial Sequence
  sgRNA
  Scn11a_15
agaccgatgttgaagagaga

SEQ ID NO: 51957 - DNA, 20 bp, Artificial Sequence
  sgRNA
  Scn11a_16
atacgcatacctttacttcg

SEQ ID NO: 51958 - DNA, 20 bp, Artificial Sequence
  sgRNA
  Scn11a_17
aagatcatcggccactccgt

SEQ ID NO: 51959 - DNA, 20 bp, Artificial Sequence
  sgRNA
  Scn11a_18
tcaagtttggtaagttcgtg

SEQ ID NO: 51960 - DNA, 20 bp, Artificial Sequence
  sgRNA
  Scn11a_19
tttctaccattccttcctgg

SEQ ID NO: 51961 - DNA, 20 bp, Artificial Sequence
  sgRNA
  Scn11a_20
gaggcgatcacccatcacca

SEQ ID NO: 51962 - DNA, 20 bp, Artificial Sequence
  sgRNA
  Scn1a_1
caagtgctgtcaaatcagcg

SEQ ID NO: 51963 - DNA, 20 bp, Artificial Sequence
  sgRNA
  Scn1a_2
cttgggttactctgaactcg

SEQ ID NO: 51964 - DNA, 20 bp, Artificial Sequence
  sgRNA
  Scn1a_3
taacttgggtacataccaca

SEQ ID NO: 51965 - DNA, 20 bp, Artificial Sequence
  sgRNA
  Scn1a_4
tttccagtcaaactcgaaca

SEQ ID NO: 51966 - DNA, 20 bp, Artificial Sequence
  sgRNA
  Scn1a_5
ttctagaagatccttcccag

SEQ ID NO: 51967 - DNA, 20 bp, Artificial Sequence
  sgRNA
  Scn1a_6
gcgcctttcaatagctgcaa

SEQ ID NO: 51968 - DNA, 20 bp, Artificial Sequence
  sgRNA
  Scn1a_7
aaagaaatgagaccgcccgg

SEQ ID NO: 51969 - DNA, 20 bp, Artificial Sequence
  sgRNA
  Scn1a_8
tggcggtgtttccagccaat

SEQ ID NO: 51970 - DNA, 20 bp, Artificial Sequence
  sgRNA
  Scn1a_9
tttcattgtgacactcagcc

SEQ ID NO: 51971 - DNA, 20 bp, Artificial Sequence
  sgRNA
  Scn1a_10
aatcgtggagaaacacgagc

SEQ ID NO: 51972 - DNA, 20 bp, Artificial Sequence
  sgRNA
  Scn1a_11
tttgtcacccgatcgtagga

SEQ ID NO: 51973 - DNA, 20 bp, Artificial Sequence
  sgRNA
  Scn1a_12
tcagttcccacatcgccagt

SEQ ID NO: 51974 - DNA, 20 bp, Artificial Sequence
  sgRNA
  Scn1a_13
ggaaggatgaaaaagccaaa

SEQ ID NO: 51975 - DNA, 20 bp, Artificial Sequence
  sgRNA
  Scn1a_14
gcaacttaagaagcagcaag

SEQ ID NO: 51976 - DNA, 20 bp, Artificial Sequence
  sgRNA
  Scn1a_15
gctgataagagaccttggag

SEQ ID NO: 51977 - DNA, 20 bp, Artificial Sequence
  sgRNA
  Scn1a_16
tagaaagaaatgagaccgcc

SEQ ID NO: 51978 - DNA, 20 bp, Artificial Sequence
  sgRNA
  Scn1a_17
agtcgttcatgtgccaacgt

SEQ ID NO: 51979 - DNA, 20 bp, Artificial Sequence
  sgRNA
  Scn1a_18
tggcaaggccaagttctacc

SEQ ID NO: 51980 - DNA, 20 bp, Artificial Sequence
  sgRNA
  Scn1a_19
ttactttccttcgcgaccca

SEQ ID NO: 51981 - DNA, 20 bp, Artificial Sequence
  sgRNA
  Scn1a_20
aacagcctcagaacattcca

SEQ ID NO: 51982 - DNA, 20 bp, Artificial Sequence
  sgRNA
  Scn1b_1
gtggtgtggaacggtagtcg

SEQ ID NO: 51983 - DNA, 20 bp, Artificial Sequence
  sgRNA
  Scn1b_2
gacattcgtagtcgccagag

SEQ ID NO: 51984 - DNA, 20 bp, Artificial Sequence
  sgRNA
  Scn1b_3
ccactccgtgaaggtttcgg

SEQ ID NO: 51985 - DNA, 20 bp, Artificial Sequence
  sgRNA
  Scn1b_4
ggaggtggattccgataccg

SEQ ID NO: 51986 - DNA, 20 bp, Artificial Sequence
  sgRNA
  Scn1b_5
ccttgtccaccacctccagg

SEQ ID NO: 51987 - DNA, 20 bp, Artificial Sequence
  sgRNA
  Scn1b_6
gcacctcattctcatagcgt

SEQ ID NO: 51988 - DNA, 20 bp, Artificial Sequence
  sgRNA
  Scn1b_7
cgtcgtcaagaagatccacc

SEQ ID NO: 51989 - DNA, 20 bp, Artificial Sequence
  sgRNA
  Scn1b_8
aaactgtacaggcgtccagg

SEQ ID NO: 51990 - DNA, 20 bp, Artificial Sequence
  sgRNA
  Scn1b_9
cgtcaagaagatccacctgg

SEQ ID NO: 51991 - DNA, 20 bp, Artificial Sequence
  sgRNA
  Scn1b_10
tgagcgctttgagggccgag

SEQ ID NO: 51992 - DNA, 20 bp, Artificial Sequence
  sgRNA
  Scn1b_11
ccgataccgaggctgtgtat

SEQ ID NO: 51993 - DNA, 20 bp, Artificial Sequence
  sgRNA
  Scn1b_12
gagtggaccttccgccagaa

SEQ ID NO: 51994 - DNA, 20 bp, Artificial Sequence
  sgRNA
  Scn1b_13
attcctctgtccccttctgg

SEQ ID NO: 51995 - DNA, 20 bp, Artificial Sequence
  sgRNA
  Scn1b_14
gactaccgttccacaccact

SEQ ID NO: 51996 - DNA, 20 bp, Artificial Sequence
  sgRNA
  Scn1b_15
agtggaccttccgccagaag

SEQ ID NO: 51997 - DNA, 20 bp, Artificial Sequence
  sgRNA
  Scn1b_16
gtagtcgccagagtggttgt

SEQ ID NO: 51998 - DNA, 20 bp, Artificial Sequence
  sgRNA
  Scn1b_17
ggtctcactacgacgcttac

SEQ ID NO: 51999 - DNA, 20 bp, Artificial Sequence
  sgRNA
  Scn1b_18
catctctgccacaagccata

SEQ ID NO: 52000 - DNA, 20 bp, Artificial Sequence
  sgRNA
  Scn1b_19
gagtggtgtggaacggtagt

SEQ ID NO: 52001 - DNA, 20 bp, Artificial Sequence
  sgRNA
  Scn1b_20
gaggaagatgagcgctttga

SEQ ID NO: 52002 - DNA, 20 bp, Artificial Sequence
  sgRNA
  Scn2a_1
ttgcatcaactacaccaccg

SEQ ID NO: 52003 - DNA, 20 bp, Artificial Sequence
  sgRNA
  Scn2a_2
cattctttgtccagtctgga

SEQ ID NO: 52004 - DNA, 20 bp, Artificial Sequence
  sgRNA
  Scn2a_3
gctcacatcaaacatttccc

SEQ ID NO: 52005 - DNA, 20 bp, Artificial Sequence
  sgRNA
  Scn2a_4
aacaacctccagatagccgt

SEQ ID NO: 52006 - DNA, 20 bp, Artificial Sequence
  sgRNA
  Scn2a_5
cagcttccgcttctttacca

SEQ ID NO: 52007 - DNA, 20 bp, Artificial Sequence
  sgRNA
  Scn2a_6
gttgcgtctcggagaaaaaa

SEQ ID NO: 52008 - DNA, 20 bp, Artificial Sequence
  sgRNA
  Scn2a_7
aatcgggataaggctcgtag

SEQ ID NO: 52009 - DNA, 20 bp, Artificial Sequence
  sgRNA
  Scn2a_8
tgtccgagctgaaagaactg

SEQ ID NO: 52010 - DNA, 20 bp, Artificial Sequence
  sgRNA
  Scn2a_9
gttgttgtaaacgctctcct

SEQ ID NO: 52011 - DNA, 20 bp, Artificial Sequence
  sgRNA
  Scn2a_10
catcctgtattggatcaacc

SEQ ID NO: 52012 - DNA, 20 bp, Artificial Sequence
  sgRNA
  Scn2a_11
cttgctctactgttgcgtct

SEQ ID NO: 52013 - DNA, 20 bp, Artificial Sequence
  sgRNA
  Scn2a_12
gcagaatccagagacttcag

SEQ ID NO: 52014 - DNA, 20 bp, Artificial Sequence
  sgRNA
  Scn2a_13
ggaggtccactatttagtat

SEQ ID NO: 52015 - DNA, 20 bp, Artificial Sequence
  sgRNA
  Scn2a_14
gggtagagtgggtatccccc

SEQ ID NO: 52016 - DNA, 20 bp, Artificial Sequence
  sgRNA
  Scn2a_15
cagcagtgtggagaagtacg

SEQ ID NO: 52017 - DNA, 20 bp, Artificial Sequence
  sgRNA
  Scn2a_16
gtttctcaagataatagcca

SEQ ID NO: 52018 - DNA, 20 bp, Artificial Sequence
  sgRNA
  Scn2a_17
gatagcgtctgtaagctcgc

SEQ ID NO: 52019 - DNA, 20 bp, Artificial Sequence
  sgRNA
  Scn2a_18
tctgctttgtggtaacagct

SEQ ID NO: 52020 - DNA, 20 bp, Artificial Sequence
  sgRNA
  Scn2a_19
gatgactcggaacagggtag

SEQ ID NO: 52021 - DNA, 20 bp, Artificial Sequence
  sgRNA
  Scn2a_20
gaacaacctccagatagccg

SEQ ID NO: 52022 - DNA, 20 bp, Artificial Sequence
  sgRNA
  Scn2b_1
ctgacacgtcgtacttactg

SEQ ID NO: 52023 - DNA, 20 bp, Artificial Sequence
  sgRNA
  Scn2b_2
agttaagagagaactgcttg

SEQ ID NO: 52024 - DNA, 20 bp, Artificial Sequence
  sgRNA
  Scn2b_3
ggagtgtaacaattgcacag

SEQ ID NO: 52025 - DNA, 20 bp, Artificial Sequence
  sgRNA
  Scn2b_4
ttgaggacactaagagtggt

SEQ ID NO: 52026 - DNA, 20 bp, Artificial Sequence
  sgRNA
  Scn2b_5
ggtaaatcttgccgtggccg

SEQ ID NO: 52027 - DNA, 20 bp, Artificial Sequence
  sgRNA
  Scn2b_6
aaccctccagaccgccaccg

SEQ ID NO: 52028 - DNA, 20 bp, Artificial Sequence
  sgRNA
  Scn2b_7
ggagcggtttggagaccgcg

SEQ ID NO: 52029 - DNA, 20 bp, Artificial Sequence
  sgRNA
  Scn2b_8
gcaccaagatgaccacagcc

SEQ ID NO: 52030 - DNA, 20 bp, Artificial Sequence
  sgRNA
  Scn2b_9
acccacgatgaccgccaccg

SEQ ID NO: 52031 - DNA, 20 bp, Artificial Sequence
  sgRNA
  Scn2b_10
ccacggcaagatttacctgc

SEQ ID NO: 52032 - DNA, 20 bp, Artificial Sequence
  sgRNA
  Scn2b_11
cctgcaggtaaatcttgccg

SEQ ID NO: 52033 - DNA, 20 bp, Artificial Sequence
  sgRNA
  Scn2b_12
acttccatgctccgccccgg

SEQ ID NO: 52034 - DNA, 20 bp, Artificial Sequence
  sgRNA
  Scn2b_13
agagcgggactccacggtgg

SEQ ID NO: 52035 - DNA, 20 bp, Artificial Sequence
  sgRNA
  Scn2b_14
ggttccctgagaactccacg

SEQ ID NO: 52036 - DNA, 20 bp, Artificial Sequence
  sgRNA
  Scn2b_15
ggatgacctgaagactgaag

SEQ ID NO: 52037 - DNA, 20 bp, Artificial Sequence
  sgRNA
  Scn2b_16
tcattaacctgaagctggag

SEQ ID NO: 52038 - DNA, 20 bp, Artificial Sequence
  sgRNA
  Scn2b_17
gccctgccttcagtctcacg

SEQ ID NO: 52039 - DNA, 20 bp, Artificial Sequence
  sgRNA
  Scn2b_18
gagaccgcgtggagttctca

SEQ ID NO: 52040 - DNA, 20 bp, Artificial Sequence
  sgRNA
  Scn2b_19
aaaagagcagaagctgagca

SEQ ID NO: 52041 - DNA, 20 bp, Artificial Sequence
  sgRNA
  Scn2b_20
gccccgtgagactgaaggca

SEQ ID NO: 52042 - DNA, 20 bp, Artificial Sequence
  sgRNA
  Scn3a_1
aaagtgatagaaatccacga

SEQ ID NO: 52043 - DNA, 20 bp, Artificial Sequence
  sgRNA
  Scn3a_2
gtgtgtttgcaagatcaatg

SEQ ID NO: 52044 - DNA, 20 bp, Artificial Sequence
  sgRNA
  Scn3a_3
ctggatgggaacccgctgag

SEQ ID NO: 52045 - DNA, 20 bp, Artificial Sequence
  sgRNA
  Scn3a_4
tatcctgaccaacacgatgg

SEQ ID NO: 52046 - DNA, 20 bp, Artificial Sequence
  sgRNA
  Scn3a_5
cggaagctctcaggtcccgg

SEQ ID NO: 52047 - DNA, 20 bp, Artificial Sequence
  sgRNA
  Scn3a_6
cagtatcctgaccaacacga

SEQ ID NO: 52048 - DNA, 20 bp, Artificial Sequence
  sgRNA
  Scn3a_7
tatcatcgtccgtagcagca

SEQ ID NO: 52049 - DNA, 20 bp, Artificial Sequence
  sgRNA
  Scn3a_8
gttgattcgggacaaaacca

SEQ ID NO: 52050 - DNA, 20 bp, Artificial Sequence
  sgRNA
  Scn3a_9
agttaaaatatacaaggcgg

SEQ ID NO: 52051 - DNA, 20 bp, Artificial Sequence
  sgRNA
  Scn3a_10
ggttgattcgggacaaaacc

SEQ ID NO: 52052 - DNA, 20 bp, Artificial Sequence
  sgRNA
  Scn3a_11
aagttcttaccagatctcga

SEQ ID NO: 52053 - DNA, 20 bp, Artificial Sequence
  sgRNA
  Scn3a_12
aggtttaaagaccatcgtgg

SEQ ID NO: 52054 - DNA, 20 bp, Artificial Sequence
  sgRNA
  Scn3a_13
gtgacggtgccaattgccgt

SEQ ID NO: 52055 - DNA, 20 bp, Artificial Sequence
  sgRNA
  Scn3a_14
gagcttaactaccttaaaga

SEQ ID NO: 52056 - DNA, 20 bp, Artificial Sequence
  sgRNA
  Scn3a_15
gctggacgaaaccccaacta

SEQ ID NO: 52057 - DNA, 20 bp, Artificial Sequence
  sgRNA
  Scn3a_16
tcagcttgttcaccttctcg

SEQ ID NO: 52058 - DNA, 20 bp, Artificial Sequence
  sgRNA
  Scn3a_17
aagtgatagaaatccacgaa

SEQ ID NO: 52059 - DNA, 20 bp, Artificial Sequence
  sgRNA
  Scn3a_18
gtcccagatcaaaaacacat

SEQ ID NO: 52060 - DNA, 20 bp, Artificial Sequence
  sgRNA
  Scn3a_19
gcaccaggcattggtgaaat

SEQ ID NO: 52061 - DNA, 20 bp, Artificial Sequence
  sgRNA
  Scn3a_20
atcttccatctggattcgaa

SEQ ID NO: 52062 - DNA, 20 bp, Artificial Sequence
  sgRNA
  Scn3b_1
tctctagtgctcatctactg

SEQ ID NO: 52063 - DNA, 20 bp, Artificial Sequence
  sgRNA
  Scn3b_2
tggacacattacatgtgtag

SEQ ID NO: 52064 - DNA, 20 bp, Artificial Sequence
  sgRNA
  Scn3b_3
tgtgtgtgtagaagtaccct

SEQ ID NO: 52065 - DNA, 20 bp, Artificial Sequence
  sgRNA
  Scn3b_4
gaaccactccactacagtgg

SEQ ID NO: 52066 - DNA, 20 bp, Artificial Sequence
  sgRNA
  Scn3b_5
agtttgagttcgaagcacac

SEQ ID NO: 52067 - DNA, 20 bp, Artificial Sequence
  sgRNA
  Scn3b_6
gtatcgaaatggccaccagg

SEQ ID NO: 52068 - DNA, 20 bp, Artificial Sequence
  sgRNA
  Scn3b_7
ggagaactctgtggtacccg

SEQ ID NO: 52069 - DNA, 20 bp, Artificial Sequence
  sgRNA
  Scn3b_8
agtcttgtggtcttcacaaa

SEQ ID NO: 52070 - DNA, 20 bp, Artificial Sequence
  sgRNA
  Scn3b_9
gggagaagacttcacctccg

SEQ ID NO: 52071 - DNA, 20 bp, Artificial Sequence
  sgRNA
  Scn3b_10
tcggagacagaagccgtgca

SEQ ID NO: 52072 - DNA, 20 bp, Artificial Sequence
  sgRNA
  Scn3b_11
catgatttccgagaccacgg

SEQ ID NO: 52073 - DNA, 20 bp, Artificial Sequence
  sgRNA
  Scn3b_12
gatgatctattgctacagaa

SEQ ID NO: 52074 - DNA, 20 bp, Artificial Sequence
  sgRNA
  Scn3b_13
ctacacatgtaatgtgtcca

SEQ ID NO: 52075 - DNA, 20 bp, Artificial Sequence
  sgRNA
  Scn3b_14
gagtggttctacaggcctga

SEQ ID NO: 52076 - DNA, 20 bp, Artificial Sequence
  sgRNA
  Scn3b_15
catctcaataaacagccaca

SEQ ID NO: 52077 - DNA, 20 bp, Artificial Sequence
  sgRNA
  Scn3b_16
cttcatggaattgccctgca

SEQ ID NO: 52078 - DNA, 20 bp, Artificial Sequence
  sgRNA
  Scn3b_17
tgttctctgaagggatagca

SEQ ID NO: 52079 - DNA, 20 bp, Artificial Sequence
  sgRNA
  Scn3b_18
gtagaaccactccactacag

SEQ ID NO: 52080 - DNA, 20 bp, Artificial Sequence
  sgRNA
  Scn3b_19
actgcagacgaccttggaag

SEQ ID NO: 52081 - DNA, 20 bp, Artificial Sequence
  sgRNA
  Scn3b_20
tgagtatcgaaatggccacc

SEQ ID NO: 52082 - DNA, 20 bp, Artificial Sequence
  sgRNA
  Scn4a_1
agagatgtcgaatctctcgg

SEQ ID NO: 52083 - DNA, 20 bp, Artificial Sequence
  sgRNA
  Scn4a_2
aggacatctacattgaacag

SEQ ID NO: 52084 - DNA, 20 bp, Artificial Sequence
  sgRNA
  Scn4a_3
cctgttggaaatattcgtag

SEQ ID NO: 52085 - DNA, 20 bp, Artificial Sequence
  sgRNA
  Scn4a_4
cgtatcattaccataccacg

SEQ ID NO: 52086 - DNA, 20 bp, Artificial Sequence
  sgRNA
  Scn4a_5
gcaccttgatagccacccgc

SEQ ID NO: 52087 - DNA, 20 bp, Artificial Sequence
  sgRNA
  Scn4a_6
cctcatcaatctgatcctgg

SEQ ID NO: 52088 - DNA, 20 bp, Artificial Sequence
  sgRNA
  Scn4a_7
tgtcttgcgtctgatccgtg

SEQ ID NO: 52089 - DNA, 20 bp, Artificial Sequence
  sgRNA
  Scn4a_8
aatgtggtggacactccgca

SEQ ID NO: 52090 - DNA, 20 bp, Artificial Sequence
  sgRNA
  Scn4a_9
tgaatgacaccaacaccacg

SEQ ID NO: 52091 - DNA, 20 bp, Artificial Sequence
  sgRNA
  Scn4a_10
actgttccgtgtgatccgat

SEQ ID NO: 52092 - DNA, 20 bp, Artificial Sequence
  sgRNA
  Scn4a_11
gccctgttggaaatattcgt

SEQ ID NO: 52093 - DNA, 20 bp, Artificial Sequence
  sgRNA
  Scn4a_12
tggtagcctggatacatccg

SEQ ID NO: 52094 - DNA, 20 bp, Artificial Sequence
  sgRNA
  Scn4a_13
cgtggtatggtaatgatacg

SEQ ID NO: 52095 - DNA, 20 bp, Artificial Sequence
  sgRNA
  Scn4a_14
gctgtggcggtacatgtaag

SEQ ID NO: 52096 - DNA, 20 bp, Artificial Sequence
  sgRNA
  Scn4a_15
agacctgcccatggtacccg

SEQ ID NO: 52097 - DNA, 20 bp, Artificial Sequence
  sgRNA
  Scn4a_16
tcttcattatcgtcttcaca

SEQ ID NO: 52098 - DNA, 20 bp, Artificial Sequence
  sgRNA
  Scn4a_17
cacgcccgatccgagccaat

SEQ ID NO: 52099 - DNA, 20 bp, Artificial Sequence
  sgRNA
  Scn4a_18
tgtgtgctatcaaaatccag

SEQ ID NO: 52100 - DNA, 20 bp, Artificial Sequence
  sgRNA
  Scn4a_19
atatgcttgaacttcaccca

SEQ ID NO: 52101 - DNA, 20 bp, Artificial Sequence
  sgRNA
  Scn4a_20
catcaatctgatcctggcgg

SEQ ID NO: 52102 - DNA, 20 bp, Artificial Sequence
  sgRNA
  Scn4b_1
gccgttaatagcgtagatgg

SEQ ID NO: 52103 - DNA, 20 bp, Artificial Sequence
  sgRNA
  Scn4b_2
tgatgatcgaatcaccctag

SEQ ID NO: 52104 - DNA, 20 bp, Artificial Sequence
  sgRNA
  Scn4b_3
acgatcccgtcgatgagctg

SEQ ID NO: 52105 - DNA, 20 bp, Artificial Sequence
  sgRNA
  Scn4b_4
ttgagaacctctacttcaag

SEQ ID NO: 52106 - DNA, 20 bp, Artificial Sequence
  sgRNA
  Scn4b_5
atctcgcctgagtattgcct

SEQ ID NO: 52107 - DNA, 20 bp, Artificial Sequence
  sgRNA
  Scn4b_6
ccacagatacctccaacgac

SEQ ID NO: 52108 - DNA, 20 bp, Artificial Sequence
  sgRNA
  Scn4b_7
tgaactccaggtcactcaag

SEQ ID NO: 52109 - DNA, 20 bp, Artificial Sequence
  sgRNA
  Scn4b_8
gcagatacacctgcttcgtg

SEQ ID NO: 52110 - DNA, 20 bp, Artificial Sequence
  sgRNA
  Scn4b_9
ctgcttcgtgaggaacccca

SEQ ID NO: 52111 - DNA, 20 bp, Artificial Sequence
  sgRNA
  Scn4b_10
agtgtctcgtgagttcctct

SEQ ID NO: 52112 - DNA, 20 bp, Artificial Sequence
  sgRNA
  Scn4b_11
taacagctggagaaggtgca

SEQ ID NO: 52113 - DNA, 20 bp, Artificial Sequence
  sgRNA
  Scn4b_12
tgccaccatcttcctccaag

SEQ ID NO: 52114 - DNA, 20 bp, Artificial Sequence
  sgRNA
  Scn4b_13
gatgatcgaatcaccctaga

SEQ ID NO: 52115 - DNA, 20 bp, Artificial Sequence
  sgRNA
  Scn4b_14
gcttcccatgtacctgtcgt

SEQ ID NO: 52116 - DNA, 20 bp, Artificial Sequence
  sgRNA
  Scn4b_15
ctgtcgttggaggtatctgt

SEQ ID NO: 52117 - DNA, 20 bp, Artificial Sequence
  sgRNA
  Scn4b_16
accaccatctacgctattaa

SEQ ID NO: 52118 - DNA, 20 bp, Artificial Sequence
  sgRNA
  Scn4b_17
gttaatagcgtagatggtgg

SEQ ID NO: 52119 - DNA, 20 bp, Artificial Sequence
  sgRNA
  Scn4b_18
ggatgtttcgctgttattgt

SEQ ID NO: 52120 - DNA, 20 bp, Artificial Sequence
  sgRNA
  Scn4b_19
tgttcaagtccttctccttg

SEQ ID NO: 52121 - DNA, 20 bp, Artificial Sequence
  sgRNA
  Scn4b_20
tgaccccgcccaccacagcc

SEQ ID NO: 52122 - DNA, 20 bp, Artificial Sequence
  sgRNA
  Scn5a_1
agtcgaagctggtgtaaccg

SEQ ID NO: 52123 - DNA, 20 bp, Artificial Sequence
  sgRNA
  Scn5a_2
gcaaatcccagacctcgggg

SEQ ID NO: 52124 - DNA, 20 bp, Artificial Sequence
  sgRNA
  Scn5a_3
ctggtcaagattctagctcg

SEQ ID NO: 52125 - DNA, 20 bp, Artificial Sequence
  sgRNA
  Scn5a_4
gcatggtggacacttacggt

SEQ ID NO: 52126 - DNA, 20 bp, Artificial Sequence
  sgRNA
  Scn5a_5
gcggcgacctaagaagcccg

SEQ ID NO: 52127 - DNA, 20 bp, Artificial Sequence
  sgRNA
  Scn5a_6
ggtccttgacgtcctccccg

SEQ ID NO: 52128 - DNA, 20 bp, Artificial Sequence
  sgRNA
  Scn5a_7
gcgtgcacttcgacccctga

SEQ ID NO: 52129 - DNA, 20 bp, Artificial Sequence
  sgRNA
  Scn5a_8
ccatgcagcaaggacaacgt

SEQ ID NO: 52130 - DNA, 20 bp, Artificial Sequence
  sgRNA
  Scn5a_9
gcgacgggaccaaggctccg

SEQ ID NO: 52131 - DNA, 20 bp, Artificial Sequence
  sgRNA
  Scn5a_10
gatctgggagaagttcgacc

SEQ ID NO: 52132 - DNA, 20 bp, Artificial Sequence
  sgRNA
  Scn5a_11
agtctgcaagatcttcgctg

SEQ ID NO: 52133 - DNA, 20 bp, Artificial Sequence
  sgRNA
  Scn5a_12
gcccctttggatgcgagcca

SEQ ID NO: 52134 - DNA, 20 bp, Artificial Sequence
  sgRNA
  Scn5a_13
agggctttgtcacgattcga

SEQ ID NO: 52135 - DNA, 20 bp, Artificial Sequence
  sgRNA
  Scn5a_14
acgccgtcagaggagccggg

SEQ ID NO: 52136 - DNA, 20 bp, Artificial Sequence
  sgRNA
  Scn5a_15
cgaacaggatgtccatacag

SEQ ID NO: 52137 - DNA, 20 bp, Artificial Sequence
  sgRNA
  Scn5a_16
tctccaccagaccttccctg

SEQ ID NO: 52138 - DNA, 20 bp, Artificial Sequence
  sgRNA
  Scn5a_17
gcaccagcagcgatgtgcgg

SEQ ID NO: 52139 - DNA, 20 bp, Artificial Sequence
  sgRNA
  Scn5a_18
agtccgacgcacgcactggg

SEQ ID NO: 52140 - DNA, 20 bp, Artificial Sequence
  sgRNA
  Scn5a_19
gtcctatgacagcgtcacga

SEQ ID NO: 52141 - DNA, 20 bp, Artificial Sequence
  sgRNA
  Scn5a_20
agagttccagactatgccat

SEQ ID NO: 52142 - DNA, 20 bp, Artificial Sequence
  sgRNA
  Scn7a_1
acagaactcttagtgctcga

SEQ ID NO: 52143 - DNA, 20 bp, Artificial Sequence
  sgRNA
  Scn7a_2
atactggaagacactaccct

SEQ ID NO: 52144 - DNA, 20 bp, Artificial Sequence
  sgRNA
  Scn7a_3
gaaggcacaaatcctgacaa

SEQ ID NO: 52145 - DNA, 20 bp, Artificial Sequence
  sgRNA
  Scn7a_4
aagattatccctttgaacca

SEQ ID NO: 52146 - DNA, 20 bp, Artificial Sequence
  sgRNA
  Scn7a_5
acaccaatcagcatacagag

SEQ ID NO: 52147 - DNA, 20 bp, Artificial Sequence
  sgRNA
  Scn7a_6
ggtgaagtagtggcaacgga

SEQ ID NO: 52148 - DNA, 20 bp, Artificial Sequence
  sgRNA
  Scn7a_7
tattcaatgaatcaatgccg

SEQ ID NO: 52149 - DNA, 20 bp, Artificial Sequence
  sgRNA
  Scn7a_8
aagtattgtcctattgtcaa

SEQ ID NO: 52150 - DNA, 20 bp, Artificial Sequence
  sgRNA
  Scn7a_9
gctctgacacggttcctcga

SEQ ID NO: 52151 - DNA, 20 bp, Artificial Sequence
  sgRNA
  Scn7a_10
gctgggagcgccagaatcaa

SEQ ID NO: 52152 - DNA, 20 bp, Artificial Sequence
  sgRNA
  Scn7a_11
agctcaccaatgtcacaaag

SEQ ID NO: 52153 - DNA, 20 bp, Artificial Sequence
  sgRNA
  Scn7a_12
gggccatcaatgagctacca

SEQ ID NO: 52154 - DNA, 20 bp, Artificial Sequence
  sgRNA
  Scn7a_13
gcatgagtaatctaccagaa

SEQ ID NO: 52155 - DNA, 20 bp, Artificial Sequence
  sgRNA
  Scn7a_14
tatggatccacatcttccaa

SEQ ID NO: 52156 - DNA, 20 bp, Artificial Sequence
  sgRNA
  Scn7a_15
ggaactttattgatgtcaga

SEQ ID NO: 52157 - DNA, 20 bp, Artificial Sequence
  sgRNA
  Scn7a_16
gcttcaggttgcccatgaag

SEQ ID NO: 52158 - DNA, 20 bp, Artificial Sequence
  sgRNA
  Scn7a_17
tgtggccatggatctcccca

SEQ ID NO: 52159 - DNA, 20 bp, Artificial Sequence
  sgRNA
  Scn7a_18
gaatgcattgacccaacaaa

SEQ ID NO: 52160 - DNA, 20 bp, Artificial Sequence
  sgRNA
  Scn7a_19
ggaacaggtttgaccctgat

SEQ ID NO: 52161 - DNA, 20 bp, Artificial Sequence
  sgRNA
  Scn7a_20
ggtcaaacctgttccacacc

SEQ ID NO: 52162 - DNA, 20 bp, Artificial Sequence
  sgRNA
  Scn8a_1
cgaactcgttctccgaaccg

SEQ ID NO: 52163 - DNA, 20 bp, Artificial Sequence
  sgRNA
  Scn8a_2
ctggtgaaaatcatcgccag

SEQ ID NO: 52164 - DNA, 20 bp, Artificial Sequence
  sgRNA
  Scn8a_3
tggagactaagagcgatcca

SEQ ID NO: 52165 - DNA, 20 bp, Artificial Sequence
  sgRNA
  Scn8a_4
cctctttcagaccttacgag

SEQ ID NO: 52166 - DNA, 20 bp, Artificial Sequence
  sgRNA
  Scn8a_5
gatcaacttcgacaacgtcg

SEQ ID NO: 52167 - DNA, 20 bp, Artificial Sequence
  sgRNA
  Scn8a_6
gttctgctcttcgtaagcca

SEQ ID NO: 52168 - DNA, 20 bp, Artificial Sequence
  sgRNA
  Scn8a_7
gatgacgcggaatagggtcg

SEQ ID NO: 52169 - DNA, 20 bp, Artificial Sequence
  sgRNA
  Scn8a_8
cgtgaaacgcaacagcaccg

SEQ ID NO: 52170 - DNA, 20 bp, Artificial Sequence
  sgRNA
  Scn8a_9
acattcttggaccattcggg

SEQ ID NO: 52171 - DNA, 20 bp, Artificial Sequence
  sgRNA
  Scn8a_10
tcggtgatccggatcaagaa

SEQ ID NO: 52172 - DNA, 20 bp, Artificial Sequence
  sgRNA
  Scn8a_11
ggagaagtacatcatcgacg

SEQ ID NO: 52173 - DNA, 20 bp, Artificial Sequence
  sgRNA
  Scn8a_12
gtcagacgtgatgatcctga

SEQ ID NO: 52174 - DNA, 20 bp, Artificial Sequence
  sgRNA
  Scn8a_13
cgaaggagcgtcggaaccga

SEQ ID NO: 52175 - DNA, 20 bp, Artificial Sequence
  sgRNA
  Scn8a_14
cctattgtctggcagccgga

SEQ ID NO: 52176 - DNA, 20 bp, Artificial Sequence
  sgRNA
  Scn8a_15
tcacctcgtcgatttcgaac

SEQ ID NO: 52177 - DNA, 20 bp, Artificial Sequence
  sgRNA
  Scn8a_16
agtcgctggcaaacatcgag

SEQ ID NO: 52178 - DNA, 20 bp, Artificial Sequence
  sgRNA
  Scn8a_17
cctattccgcgtcatccgat

SEQ ID NO: 52179 - DNA, 20 bp, Artificial Sequence
  sgRNA
  Scn8a_18
tctgcttcctcttcttccgt

SEQ ID NO: 52180 - DNA, 20 bp, Artificial Sequence
  sgRNA
  Scn8a_19
gttcctgtgaatgtccacgc

SEQ ID NO: 52181 - DNA, 20 bp, Artificial Sequence
  sgRNA
  Scn8a_20
tgtcttcatcgtcctcccgg

SEQ ID NO: 52182 - DNA, 20 bp, Artificial Sequence
  sgRNA
  Scn9a_1
gccagttccaagggtcacgg

SEQ ID NO: 52183 - DNA, 20 bp, Artificial Sequence
  sgRNA
  Scn9a_2
gtgtccgtagagatttaatg

SEQ ID NO: 52184 - DNA, 20 bp, Artificial Sequence
  sgRNA
  Scn9a_3
tatctcaaaccgtacccttg

SEQ ID NO: 52185 - DNA, 20 bp, Artificial Sequence
  sgRNA
  Scn9a_4
ctgagtacacgagtttaggg

SEQ ID NO: 52186 - DNA, 20 bp, Artificial Sequence
  sgRNA
  Scn9a_5
ctttagaatgaattcacgca

SEQ ID NO: 52187 - DNA, 20 bp, Artificial Sequence
  sgRNA
  Scn9a_6
tcattcagcgtgcttacaga

SEQ ID NO: 52188 - DNA, 20 bp, Artificial Sequence
  sgRNA
  Scn9a_7
ttactgctgcgccgctcccg

SEQ ID NO: 52189 - DNA, 20 bp, Artificial Sequence
  sgRNA
  Scn9a_8
gtagtggtcaacgcactcat

SEQ ID NO: 52190 - DNA, 20 bp, Artificial Sequence
  sgRNA
  Scn9a_9
tgtgctatactggatcaacg

SEQ ID NO: 52191 - DNA, 20 bp, Artificial Sequence
  sgRNA
  Scn9a_10
gtaacatcagccaggccagt

SEQ ID NO: 52192 - DNA, 20 bp, Artificial Sequence
  sgRNA
  Scn9a_11
ggctctgacaccattcccgg

SEQ ID NO: 52193 - DNA, 20 bp, Artificial Sequence
  sgRNA
  Scn9a_12
tcagggcaaaacactcagaa

SEQ ID NO: 52194 - DNA, 20 bp, Artificial Sequence
  sgRNA
  Scn9a_13
taaactcgtgtactcagcag

SEQ ID NO: 52195 - DNA, 20 bp, Artificial Sequence
  sgRNA
  Scn9a_14
aggactaaaaaccatcgtgg

SEQ ID NO: 52196 - DNA, 20 bp, Artificial Sequence
  sgRNA
  Scn9a_15
gacccaaaaaaggttcaccc

SEQ ID NO: 52197 - DNA, 20 bp, Artificial Sequence
  sgRNA
  Scn9a_16
ggttcacccaggaagttcag

SEQ ID NO: 52198 - DNA, 20 bp, Artificial Sequence
  sgRNA
  Scn9a_17
atttgtaccccatagacccc

SEQ ID NO: 52199 - DNA, 20 bp, Artificial Sequence
  sgRNA
  Scn9a_18
atgttagtggaaatgtgcga

SEQ ID NO: 52200 - DNA, 20 bp, Artificial Sequence
  sgRNA
  Scn9a_19
gcagtggccagaattaaaag

SEQ ID NO: 52201 - DNA, 20 bp, Artificial Sequence
  sgRNA
  Scn9a_20
acagaagctgtccagtggcg

SEQ ID NO: 52202 - DNA, 20 bp, Artificial Sequence
  sgRNA
  Scnn1a_1
ccagacatactcatccgggg

SEQ ID NO: 52203 - DNA, 20 bp, Artificial Sequence
  sgRNA
  Scnn1a_2
tgtagcagttcccatacatg

SEQ ID NO: 52204 - DNA, 20 bp, Artificial Sequence
  sgRNA
  Scnn1a_3
ctgccagtacatcatgccga

SEQ ID NO: 52205 - DNA, 20 bp, Artificial Sequence
  sgRNA
  Scnn1a_4
aaagcgtctgttccgtgatg

SEQ ID NO: 52206 - DNA, 20 bp, Artificial Sequence
  sgRNA
  Scnn1a_5
ctaccagacatactcatccg

SEQ ID NO: 52207 - DNA, 20 bp, Artificial Sequence
  sgRNA
  Scnn1a_6
ggtgtgggagagcaccccgg

SEQ ID NO: 52208 - DNA, 20 bp, Artificial Sequence
  sgRNA
  Scnn1a_7
gtactggtctccaggacgag

SEQ ID NO: 52209 - DNA, 20 bp, Artificial Sequence
  sgRNA
  Scnn1a_8
gacgtctccaactcaccgaa

SEQ ID NO: 52210 - DNA, 20 bp, Artificial Sequence
  sgRNA
  Scnn1a_9
tccatgcctggagtcaacaa

SEQ ID NO: 52211 - DNA, 20 bp, Artificial Sequence
  sgRNA
  Scnn1a_10
gctgaactataaaactaatt

SEQ ID NO: 52212 - DNA, 20 bp, Artificial Sequence
  sgRNA
  Scnn1a_11
ggaagagctcccggtaggag

SEQ ID NO: 52213 - DNA, 20 bp, Artificial Sequence
  sgRNA
  Scnn1a_12
gagctccgccatttccacca

SEQ ID NO: 52214 - DNA, 20 bp, Artificial Sequence
  sgRNA
  Scnn1a_13
tgacgtctccaactcaccga

SEQ ID NO: 52215 - DNA, 20 bp, Artificial Sequence
  sgRNA
  Scnn1a_14
ggttgatgttgagactcacg

SEQ ID NO: 52216 - DNA, 20 bp, Artificial Sequence
  sgRNA
  Scnn1a_15
ctactgctactataaactgc

SEQ ID NO: 52217 - DNA, 20 bp, Artificial Sequence
  sgRNA
  Scnn1a_16
ggtactggtctccaggacga

SEQ ID NO: 52218 - DNA, 20 bp, Artificial Sequence
  sgRNA
  Scnn1a_17
tcgagttccaccgctcctac

SEQ ID NO: 52219 - DNA, 20 bp, Artificial Sequence
  sgRNA
  Scnn1a_18
tctctgctggctactcaaga

SEQ ID NO: 52220 - DNA, 20 bp, Artificial Sequence
  sgRNA
  Scnn1a_19
acaccaggcggatggcaccg

SEQ ID NO: 52221 - DNA, 20 bp, Artificial Sequence
  sgRNA
  Scnn1a_20
agttccaccaccccatgtat

SEQ ID NO: 52222 - DNA, 20 bp, Artificial Sequence
  sgRNA
  Scnn1b_1
caagacgatgaacttcccgg

SEQ ID NO: 52223 - DNA, 20 bp, Artificial Sequence
  sgRNA
  Scnn1b_2
gacgtaccccttcattagag

SEQ ID NO: 52224 - DNA, 20 bp, Artificial Sequence
  sgRNA
  Scnn1b_3
agctaggattatgcgatcag

SEQ ID NO: 52225 - DNA, 20 bp, Artificial Sequence
  sgRNA
  Scnn1b_4
agagaaatactgcaacaaca

SEQ ID NO: 52226 - DNA, 20 bp, Artificial Sequence
  sgRNA
  Scnn1b_5
ggcactggtgaagttccgca

SEQ ID NO: 52227 - DNA, 20 bp, Artificial Sequence
  sgRNA
  Scnn1b_6
ggtcagggtagacctcgccg

SEQ ID NO: 52228 - DNA, 20 bp, Artificial Sequence
  sgRNA
  Scnn1b_7
cgctcatcaataaggaccag

SEQ ID NO: 52229 - DNA, 20 bp, Artificial Sequence
  sgRNA
  Scnn1b_8
gtataagatgaccatctcca

SEQ ID NO: 52230 - DNA, 20 bp, Artificial Sequence
  sgRNA
  Scnn1b_9
tcagggtagacctcgccgtg

SEQ ID NO: 52231 - DNA, 20 bp, Artificial Sequence
  sgRNA
  Scnn1b_10
ccctggtccttattgatgag

SEQ ID NO: 52232 - DNA, 20 bp, Artificial Sequence
  sgRNA
  Scnn1b_11
tggtgttgtagacactgtag

SEQ ID NO: 52233 - DNA, 20 bp, Artificial Sequence
  sgRNA
  Scnn1b_12
aacagactctgcccatcccg

SEQ ID NO: 52234 - DNA, 20 bp, Artificial Sequence
  sgRNA
  Scnn1b_13
tccgactccatggtgtccag

SEQ ID NO: 52235 - DNA, 20 bp, Artificial Sequence
  sgRNA
  Scnn1b_14
gccggtgcaggcacttcagg

SEQ ID NO: 52236 - DNA, 20 bp, Artificial Sequence
  sgRNA
  Scnn1b_15
acaaattgagaaccaccggg

SEQ ID NO: 52237 - DNA, 20 bp, Artificial Sequence
  sgRNA
  Scnn1b_16
gttcatcgtcttgaagccca

SEQ ID NO: 52238 - DNA, 20 bp, Artificial Sequence
  sgRNA
  Scnn1b_17
cccccaactatgactccctg

SEQ ID NO: 52239 - DNA, 20 bp, Artificial Sequence
  sgRNA
  Scnn1b_18
ggcccaagaagaaggccatg

SEQ ID NO: 52240 - DNA, 20 bp, Artificial Sequence
  sgRNA
  Scnn1b_19
tgatctccccaaactcaatg

SEQ ID NO: 52241 - DNA, 20 bp, Artificial Sequence
  sgRNA
  Scnn1b_20
ccataatcagggtagaagat

SEQ ID NO: 52242 - DNA, 20 bp, Artificial Sequence
  sgRNA
  Scnn1g_1
taccctttcatcgaagacgt

SEQ ID NO: 52243 - DNA, 20 bp, Artificial Sequence
  sgRNA
  Scnn1g_2
ggcgcactgccagataatga

SEQ ID NO: 52244 - DNA, 20 bp, Artificial Sequence
  sgRNA
  Scnn1g_3
gggtggtgtgccttcccacg

SEQ ID NO: 52245 - DNA, 20 bp, Artificial Sequence
  sgRNA
  Scnn1g_4
acgaagatggtggaaaaatg

SEQ ID NO: 52246 - DNA, 20 bp, Artificial Sequence
  sgRNA
  Scnn1g_5
acttcttcactggtcggaag

SEQ ID NO: 52247 - DNA, 20 bp, Artificial Sequence
  sgRNA
  Scnn1g_6
ctattattgcccgccgccag

SEQ ID NO: 52248 - DNA, 20 bp, Artificial Sequence
  sgRNA
  Scnn1g_7
gtcggaagcggaaaatcagt

SEQ ID NO: 52249 - DNA, 20 bp, Artificial Sequence
  sgRNA
  Scnn1g_8
cctgcttcccggcgtttccg

SEQ ID NO: 52250 - DNA, 20 bp, Artificial Sequence
  sgRNA
  Scnn1g_9
tctcattgaagaccaacaat

SEQ ID NO: 52251 - DNA, 20 bp, Artificial Sequence
  sgRNA
  Scnn1g_10
cagtacacctcggaaacgcc

SEQ ID NO: 52252 - DNA, 20 bp, Artificial Sequence
  sgRNA
  Scnn1g_11
cgcatagcagaggtaaaagt

SEQ ID NO: 52253 - DNA, 20 bp, Artificial Sequence
  sgRNA
  Scnn1g_12
gccttcccacgtggaccgca

SEQ ID NO: 52254 - DNA, 20 bp, Artificial Sequence
  sgRNA
  Scnn1g_13
ggtcggaagcggaaaatcag

SEQ ID NO: 52255 - DNA, 20 bp, Artificial Sequence
  sgRNA
  Scnn1g_14
cgcaaggtattgtatctggg

SEQ ID NO: 52256 - DNA, 20 bp, Artificial Sequence
  sgRNA
  Scnn1g_15
cggcgcatcgtggtgtcccg

SEQ ID NO: 52257 - DNA, 20 bp, Artificial Sequence
  sgRNA
  Scnn1g_16
gccgggaagcaggatccatg

SEQ ID NO: 52258 - DNA, 20 bp, Artificial Sequence
  sgRNA
  Scnn1g_17
ggataatccagccctggata

SEQ ID NO: 52259 - DNA, 20 bp, Artificial Sequence
  sgRNA
  Scnn1g_18
gtaaggttcgctcagcttga

SEQ ID NO: 52260 - DNA, 20 bp, Artificial Sequence
  sgRNA
  Scnn1g_19
cagatcatcgtccgtatcca

SEQ ID NO: 52261 - DNA, 20 bp, Artificial Sequence
  sgRNA
  Scnn1g_20
tcgtttggaagcatgagtaa

SEQ ID NO: 52262 - DNA, 20 bp, Artificial Sequence
  sgRNA
  Sctr_1
agcagacggtgagaatacga

SEQ ID NO: 52263 - DNA, 20 bp, Artificial Sequence
  sgRNA
  Sctr_2
tgtcaccagacactttctgg

SEQ ID NO: 52264 - DNA, 20 bp, Artificial Sequence
  sgRNA
  Sctr_3
agtaggtgacgtcatctgcg

SEQ ID NO: 52265 - DNA, 20 bp, Artificial Sequence
  sgRNA
  Sctr_4
tgcccagattgtgtgatgtg

SEQ ID NO: 52266 - DNA, 20 bp, Artificial Sequence
  sgRNA
  Sctr_5
gcagaagcagtgacagccgg

SEQ ID NO: 52267 - DNA, 20 bp, Artificial Sequence
  sgRNA
  Sctr_6
accgtgtacgaaggagcaga

SEQ ID NO: 52268 - DNA, 20 bp, Artificial Sequence
  sgRNA
  Sctr_7
tctgttccggaactgcacaa

SEQ ID NO: 52269 - DNA, 20 bp, Artificial Sequence
  sgRNA
  Sctr_8
ccttgatgaaccgtgtacga

SEQ ID NO: 52270 - DNA, 20 bp, Artificial Sequence
  sgRNA
  Sctr_9
gcatcatggccaactacgcg

SEQ ID NO: 52271 - DNA, 20 bp, Artificial Sequence
  sgRNA
  Sctr_10
cgaagagcacaaatgcctgc

SEQ ID NO: 52272 - DNA, 20 bp, Artificial Sequence
  sgRNA
  Sctr_11
atggctcctttaatgagaga

SEQ ID NO: 52273 - DNA, 20 bp, Artificial Sequence
  sgRNA
  Sctr_12
gctggtcagaaaccttcccc

SEQ ID NO: 52274 - DNA, 20 bp, Artificial Sequence
  sgRNA
  Sctr_13
accgtctgctccttcgtaca

SEQ ID NO: 52275 - DNA, 20 bp, Artificial Sequence
  sgRNA
  Sctr_14
acatgaccttgagcttcagc

SEQ ID NO: 52276 - DNA, 20 bp, Artificial Sequence
  sgRNA
  Sctr_15
ccatctggtgggtcattcga

SEQ ID NO: 52277 - DNA, 20 bp, Artificial Sequence
  sgRNA
  Sctr_16
tcaactccaacgcttccatc

SEQ ID NO: 52278 - DNA, 20 bp, Artificial Sequence
  sgRNA
  Sctr_17
gagaacatcctcaggaactt

SEQ ID NO: 52279 - DNA, 20 bp, Artificial Sequence
  sgRNA
  Sctr_18
tgtagtggatgccaaagaga

SEQ ID NO: 52280 - DNA, 20 bp, Artificial Sequence
  sgRNA
  Sctr_19
ccaggagcgtgtgaagatag

SEQ ID NO: 52281 - DNA, 20 bp, Artificial Sequence
  sgRNA
  Sctr_20
gcatttgtgctcttcggatg

SEQ ID NO: 52282 - DNA, 20 bp, Artificial Sequence
  sgRNA
  Sdc1_1
gtcacatctcatccgcacgg

SEQ ID NO: 52283 - DNA, 20 bp, Artificial Sequence
  sgRNA
  Sdc1_2
aggaaaaggaggtcaccacc

SEQ ID NO: 52284 - DNA, 20 bp, Artificial Sequence
  sgRNA
  Sdc1_3
cacacgtccttccaagtgga

SEQ ID NO: 52285 - DNA, 20 bp, Artificial Sequence
  sgRNA
  Sdc1_4
tgtcatcaaagaggttgtcg

SEQ ID NO: 52286 - DNA, 20 bp, Artificial Sequence
  sgRNA
  Sdc1_5
ggtacagcatgaaagccacc

SEQ ID NO: 52287 - DNA, 20 bp, Artificial Sequence
  sgRNA
  Sdc1_6
gctgtaccggatgaagaaga

SEQ ID NO: 52288 - DNA, 20 bp, Artificial Sequence
  sgRNA
  Sdc1_7
actgccaatcagcttcccgc

SEQ ID NO: 52289 - DNA, 20 bp, Artificial Sequence
  sgRNA
  Sdc1_8
cctgcggaatcagcccccgg

SEQ ID NO: 52290 - DNA, 20 bp, Artificial Sequence
  sgRNA
  Sdc1_9
tgcagctccccatcacccaa

SEQ ID NO: 52291 - DNA, 20 bp, Artificial Sequence
  sgRNA
  Sdc1_10
cggcacttctgtcatcaaag

SEQ ID NO: 52292 - DNA, 20 bp, Artificial Sequence
  sgRNA
  Sdc1_11
tcctcgggcttctctccggc

SEQ ID NO: 52293 - DNA, 20 bp, Artificial Sequence
  sgRNA
  Sdc1_12
ccaggcacacagcaaagatg

SEQ ID NO: 52294 - DNA, 20 bp, Artificial Sequence
  sgRNA
  Sdc1_13
gctgtcacatctcatccgca

SEQ ID NO: 52295 - DNA, 20 bp, Artificial Sequence
  sgRNA
  Sdc1_14
ccaggttgcatgcccccgtg

SEQ ID NO: 52296 - DNA, 20 bp, Artificial Sequence
  sgRNA
  Sdc1_15
catcagcctccacgtgtgga

SEQ ID NO: 52297 - DNA, 20 bp, Artificial Sequence
  sgRNA
  Sdc1_16
gacaggaaggaagtgctggg

SEQ ID NO: 52298 - DNA, 20 bp, Artificial Sequence
  sgRNA
  Sdc1_17
gctgtggctgccgtagagcc

SEQ ID NO: 52299 - DNA, 20 bp, Artificial Sequence
  sgRNA
  Sdc1_18
gcacttccttcctgtccaaa

SEQ ID NO: 52300 - DNA, 20 bp, Artificial Sequence
  sgRNA
  Sdc1_19
tgctcgggacaaggaaaagg

SEQ ID NO: 52301 - DNA, 20 bp, Artificial Sequence
  sgRNA
  Sdc1_20
cttcttcccgcgctgcctgg

SEQ ID NO: 52302 - DNA, 20 bp, Artificial Sequence
  sgRNA
  Sdc2_1
ggggaagcagcactagtgag

SEQ ID NO: 52303 - DNA, 20 bp, Artificial Sequence
  sgRNA
  Sdc2_2
gtcacctgaagaaactgaca

SEQ ID NO: 52304 - DNA, 20 bp, Artificial Sequence
  sgRNA
  Sdc2_3
ccttgacaatagctccattg

SEQ ID NO: 52305 - DNA, 20 bp, Artificial Sequence
  sgRNA
  Sdc2_4
gatgactattcttctgcctc

SEQ ID NO: 52306 - DNA, 20 bp, Artificial Sequence
  sgRNA
  Sdc2_5
gcatgcggtacaccaatagc

SEQ ID NO: 52307 - DNA, 20 bp, Artificial Sequence
  sgRNA
  Sdc2_6
gtcaaggtacatatccttat

SEQ ID NO: 52308 - DNA, 20 bp, Artificial Sequence
  sgRNA
  Sdc2_7
atccagcgcagcttaccaga

SEQ ID NO: 52309 - DNA, 20 bp, Artificial Sequence
  sgRNA
  Sdc2_8
ttaccagaaggcacccacta

SEQ ID NO: 52310 - DNA, 20 bp, Artificial Sequence
  sgRNA
  Sdc2_9
tggatggtttgcgttctcca

SEQ ID NO: 52311 - DNA, 20 bp, Artificial Sequence
  sgRNA
  Sdc2_10
gatcacaccaccagcaatga

SEQ ID NO: 52312 - DNA, 20 bp, Artificial Sequence
  sgRNA
  Sdc2_11
cgtcatggtttccactttgg

SEQ ID NO: 52313 - DNA, 20 bp, Artificial Sequence
  sgRNA
  Sdc2_12
tactcctgaagcttcctcaa

SEQ ID NO: 52314 - DNA, 20 bp, Artificial Sequence
  sgRNA
  Sdc2_13
ggtacaccaatagcaggatg

SEQ ID NO: 52315 - DNA, 20 bp, Artificial Sequence
  sgRNA
  Sdc2_14
tagtgctgcttcccccaaag

SEQ ID NO: 52316 - DNA, 20 bp, Artificial Sequence
  sgRNA
  Sdc2_15
ggaggaagttgacatttctg

SEQ ID NO: 52317 - DNA, 20 bp, Artificial Sequence
  sgRNA
  Sdc2_16
tctgaggcagaagagaagct

SEQ ID NO: 52318 - DNA, 20 bp, Artificial Sequence
  sgRNA
  Sdc2_17
gatgaaggaagctacgacct

SEQ ID NO: 52319 - DNA, 20 bp, Artificial Sequence
  sgRNA
  Sdc2_18
gctttgtgtcttcaacgtca

SEQ ID NO: 52320 - DNA, 20 bp, Artificial Sequence
  sgRNA
  Sdc2_19
gtgggattcttggaatcagt

SEQ ID NO: 52321 - DNA, 20 bp, Artificial Sequence
  sgRNA
  Sdc2_20
gtcattgctggtggtgtgat

SEQ ID NO: 52322 - DNA, 20 bp, Artificial Sequence
  sgRNA
  Sdk1_1
tgtgaaatcatatccgaggg

SEQ ID NO: 52323 - DNA, 20 bp, Artificial Sequence
  sgRNA
  Sdk1_2
aatgaggcaagtgaacatcg

SEQ ID NO: 52324 - DNA, 20 bp, Artificial Sequence
  sgRNA
  Sdk1_3
tgtgcgaggcgacactccgg

SEQ ID NO: 52325 - DNA, 20 bp, Artificial Sequence
  sgRNA
  Sdk1_4
gaaggtgtgaggactaccgc

SEQ ID NO: 52326 - DNA, 20 bp, Artificial Sequence
  sgRNA
  Sdk1_5
tcgtccccttaatcaccacg

SEQ ID NO: 52327 - DNA, 20 bp, Artificial Sequence
  sgRNA
  Sdk1_6
agctgaagccccgttctacg

SEQ ID NO: 52328 - DNA, 20 bp, Artificial Sequence
  sgRNA
  Sdk1_7
tcaccctccagaagaccgcg

SEQ ID NO: 52329 - DNA, 20 bp, Artificial Sequence
  sgRNA
  Sdk1_8
gctgccaacggcatcctaca

SEQ ID NO: 52330 - DNA, 20 bp, Artificial Sequence
  sgRNA
  Sdk1_9
acagtgaccctggataacgg

SEQ ID NO: 52331 - DNA, 20 bp, Artificial Sequence
  sgRNA
  Sdk1_10
gtaccagtggaagtcttcgt

SEQ ID NO: 52332 - DNA, 20 bp, Artificial Sequence
  sgRNA
  Sdk1_11
tgtggttccctcgtaccacg

SEQ ID NO: 52333 - DNA, 20 bp, Artificial Sequence
  sgRNA
  Sdk1_12
ccaccactcctcgtagaacg

SEQ ID NO: 52334 - DNA, 20 bp, Artificial Sequence
  sgRNA
  Sdk1_13
atagccctgtaggatgccgt

SEQ ID NO: 52335 - DNA, 20 bp, Artificial Sequence
  sgRNA
  Sdk1_14
ggctgtgaattgccgcaccg

SEQ ID NO: 52336 - DNA, 20 bp, Artificial Sequence
  sgRNA
  Sdk1_15
ggcaaaacctccgttatcca

SEQ ID NO: 52337 - DNA, 20 bp, Artificial Sequence
  sgRNA
  Sdk1_16
cgttgcaccgtatttcaaaa

SEQ ID NO: 52338 - DNA, 20 bp, Artificial Sequence
  sgRNA
  Sdk1_17
tctccaccccgaccaagccc

SEQ ID NO: 52339 - DNA, 20 bp, Artificial Sequence
  sgRNA
  Sdk1_18
cgtcatcccgtcagtaaccg

SEQ ID NO: 52340 - DNA, 20 bp, Artificial Sequence
  sgRNA
  Sdk1_19
ggtgacctacgagttccggg

SEQ ID NO: 52341 - DNA, 20 bp, Artificial Sequence
  sgRNA
  Sdk1_20
tcgtagcctcaggctccagt

SEQ ID NO: 52342 - DNA, 20 bp, Artificial Sequence
  sgRNA
  Sdk2_1
ccgctggagcgagatcccgg

SEQ ID NO: 52343 - DNA, 20 bp, Artificial Sequence
  sgRNA
  Sdk2_2
tgcgcacacacgaggacggt

SEQ ID NO: 52344 - DNA, 20 bp, Artificial Sequence
  sgRNA
  Sdk2_3
ggggcctctggtgatattag

SEQ ID NO: 52345 - DNA, 20 bp, Artificial Sequence
  sgRNA
  Sdk2_4
atggaccaattacgagatcg

SEQ ID NO: 52346 - DNA, 20 bp, Artificial Sequence
  sgRNA
  Sdk2_5
tggcagccttcaatgctgcg

SEQ ID NO: 52347 - DNA, 20 bp, Artificial Sequence
  sgRNA
  Sdk2_6
ggccctgcatcggatccact

SEQ ID NO: 52348 - DNA, 20 bp, Artificial Sequence
  sgRNA
  Sdk2_7
gctgaacttgaccgagcccg

SEQ ID NO: 52349 - DNA, 20 bp, Artificial Sequence
  sgRNA
  Sdk2_8
gctcaccatcgccaacccca

SEQ ID NO: 52350 - DNA, 20 bp, Artificial Sequence
  sgRNA
  Sdk2_9
tttctgtccaggcggatccg

SEQ ID NO: 52351 - DNA, 20 bp, Artificial Sequence
  sgRNA
  Sdk2_10
ccacctctgtgctaatccga

SEQ ID NO: 52352 - DNA, 20 bp, Artificial Sequence
  sgRNA
  Sdk2_11
tgggagtcagagatctccga

SEQ ID NO: 52353 - DNA, 20 bp, Artificial Sequence
  sgRNA
  Sdk2_12
gcagcggtagaagccagcgt

SEQ ID NO: 52354 - DNA, 20 bp, Artificial Sequence
  sgRNA
  Sdk2_13
tcgaggcatcaacaaccctg

SEQ ID NO: 52355 - DNA, 20 bp, Artificial Sequence
  sgRNA
  Sdk2_14
agttctttacggacagccga

SEQ ID NO: 52356 - DNA, 20 bp, Artificial Sequence
  sgRNA
  Sdk2_15
gggcaagtatgtgctctacg

SEQ ID NO: 52357 - DNA, 20 bp, Artificial Sequence
  sgRNA
  Sdk2_16
ccaagcccgcagttcatcaa

SEQ ID NO: 52358 - DNA, 20 bp, Artificial Sequence
  sgRNA
  Sdk2_17
agagggctgttgccgtcgaa

SEQ ID NO: 52359 - DNA, 20 bp, Artificial Sequence
  sgRNA
  Sdk2_18
ttcggttacgcacgatgcag

SEQ ID NO: 52360 - DNA, 20 bp, Artificial Sequence
  sgRNA
  Sdk2_19
cggcgacagcgagttcagcg

SEQ ID NO: 52361 - DNA, 20 bp, Artificial Sequence
  sgRNA
  Sdk2_20
gctgtagcagggcccccatt

SEQ ID NO: 52362 - DNA, 20 bp, Artificial Sequence
  sgRNA
  Sectm1a_1
atcttcgataaaaagcccca

SEQ ID NO: 52363 - DNA, 20 bp, Artificial Sequence
  sgRNA
  Sectm1a_2
gccacaagtatatccctgtg

SEQ ID NO: 52364 - DNA, 20 bp, Artificial Sequence
  sgRNA
  Sectm1a_3
gacaaccctatctgcacgga

SEQ ID NO: 52365 - DNA, 20 bp, Artificial Sequence
  sgRNA
  Sectm1a_4
agacagctggatggtgacat

SEQ ID NO: 52366 - DNA, 20 bp, Artificial Sequence
  sgRNA
  Sectm1a_5
ggacaaccctatctgcacgg

SEQ ID NO: 52367 - DNA, 20 bp, Artificial Sequence
  sgRNA
  Sectm1a_6
gcttgtgatcaaagacaccc

SEQ ID NO: 52368 - DNA, 20 bp, Artificial Sequence
  sgRNA
  Sectm1a_7
gcgaagagctctccaataga

SEQ ID NO: 52369 - DNA, 20 bp, Artificial Sequence
  sgRNA
  Sectm1a_8
tcgttcctagaagccccaga

SEQ ID NO: 52370 - DNA, 20 bp, Artificial Sequence
  sgRNA
  Sectm1a_9
gggagctccaagttcaaggg

SEQ ID NO: 52371 - DNA, 20 bp, Artificial Sequence
  sgRNA
  Sectm1a_10
tctggggcttctaggaacga

SEQ ID NO: 52372 - DNA, 20 bp, Artificial Sequence
  sgRNA
  Sectm1a_11
gattgcctcgaggcacagac

SEQ ID NO: 52373 - DNA, 20 bp, Artificial Sequence
  sgRNA
  Sectm1a_12
gagcattcagggagaccacc

SEQ ID NO: 52374 - DNA, 20 bp, Artificial Sequence
  sgRNA
  Sectm1a_13
atcactgcaggattgcctcg

SEQ ID NO: 52375 - DNA, 20 bp, Artificial Sequence
  sgRNA
  Sectm1a_14
caggatgctgaacagccaga

SEQ ID NO: 52376 - DNA, 20 bp, Artificial Sequence
  sgRNA
  Sectm1a_15
tgacagtgatgactcccaca

SEQ ID NO: 52377 - DNA, 20 bp, Artificial Sequence
  sgRNA
  Sectm1a_16
gggaccttgtcctcgttgga

SEQ ID NO: 52378 - DNA, 20 bp, Artificial Sequence
  sgRNA
  Sectm1a_17
atatacttgtggcagctgca

SEQ ID NO: 52379 - DNA, 20 bp, Artificial Sequence
  sgRNA
  Sectm1a_18
gacagtgatgactcccacaa

SEQ ID NO: 52380 - DNA, 20 bp, Artificial Sequence
  sgRNA
  Sectm1a_19
aaggaaacttctcttggcgt

SEQ ID NO: 52381 - DNA, 20 bp, Artificial Sequence
  sgRNA
  Sectm1a_20
ggatgccctccgtgcagata

SEQ ID NO: 52382 - DNA, 20 bp, Artificial Sequence
  sgRNA
  Sectm1b_1
acttcatgctcagtgcaaca

SEQ ID NO: 52383 - DNA, 20 bp, Artificial Sequence
  sgRNA
  Sectm1b_2
tattacaggccatcaccacg

SEQ ID NO: 52384 - DNA, 20 bp, Artificial Sequence
  sgRNA
  Sectm1b_3
tgctcagggcaaacactcag

SEQ ID NO: 52385 - DNA, 20 bp, Artificial Sequence
  sgRNA
  Sectm1b_4
atcttcaatcaaacgcctcc

SEQ ID NO: 52386 - DNA, 20 bp, Artificial Sequence
  sgRNA
  Sectm1b_5
tgtaaacagaggcagccgcg

SEQ ID NO: 52387 - DNA, 20 bp, Artificial Sequence
  sgRNA
  Sectm1b_6
tttactggtaaccaactcaa

SEQ ID NO: 52388 - DNA, 20 bp, Artificial Sequence
  sgRNA
  Sectm1b_7
gggaggctgccagtagaagg

SEQ ID NO: 52389 - DNA, 20 bp, Artificial Sequence
  sgRNA
  Sectm1b_8
ataagcccccaactgcagtg

SEQ ID NO: 52390 - DNA, 20 bp, Artificial Sequence
  sgRNA
  Sectm1b_9
tccttagagtagtttcctgg

SEQ ID NO: 52391 - DNA, 20 bp, Artificial Sequence
  sgRNA
  Sectm1b_10
ggaggctgccagtagaagga

SEQ ID NO: 52392 - DNA, 20 bp, Artificial Sequence
  sgRNA
  Sectm1b_11
tggcagcttcatattcaagg

SEQ ID NO: 52393 - DNA, 20 bp, Artificial Sequence
  sgRNA
  Sectm1b_12
atggttataggcattcaggg

SEQ ID NO: 52394 - DNA, 20 bp, Artificial Sequence
  sgRNA
  Sectm1b_13
ggagacccatgaatcagaca

SEQ ID NO: 52395 - DNA, 20 bp, Artificial Sequence
  sgRNA
  Sectm1b_14
catgaagtatctgtaaacag

SEQ ID NO: 52396 - DNA, 20 bp, Artificial Sequence
  sgRNA
  Sectm1b_15
tctgtccgcactgcagttgg

SEQ ID NO: 52397 - DNA, 20 bp, Artificial Sequence
  sgRNA
  Sectm1b_16
tttgtatctgtggagctaca

SEQ ID NO: 52398 - DNA, 20 bp, Artificial Sequence
  sgRNA
  Sectm1b_17
gcaaacactcaggggagtac

SEQ ID NO: 52399 - DNA, 20 bp, Artificial Sequence
  sgRNA
  Sectm1b_18
gctctgggccctccttctac

SEQ ID NO: 52400 - DNA, 20 bp, Artificial Sequence
  sgRNA
  Sectm1b_19
gattcctgtgatgatgatgg

SEQ ID NO: 52401 - DNA, 20 bp, Artificial Sequence
  sgRNA
  Sectm1b_20
gatgctcagggcaaacactc

SEQ ID NO: 52402 - DNA, 20 bp, Artificial Sequence
  sgRNA
  Sele_1
agaggacgtacaccgcacgg

SEQ ID NO: 52403 - DNA, 20 bp, Artificial Sequence
  sgRNA
  Sele_2
caataacgtatggatctggg

SEQ ID NO: 52404 - DNA, 20 bp, Artificial Sequence
  sgRNA
  Sele_3
gcacgtttgactgtgtggaa

SEQ ID NO: 52405 - DNA, 20 bp, Artificial Sequence
  sgRNA
  Sele_4
atccaacgaaccaaagactc

SEQ ID NO: 52406 - DNA, 20 bp, Artificial Sequence
  sgRNA
  Sele_5
gcagaaagtgcaactaccaa

SEQ ID NO: 52407 - DNA, 20 bp, Artificial Sequence
  sgRNA
  Sele_6
aggttgaatgcagcgcacaa

SEQ ID NO: 52408 - DNA, 20 bp, Artificial Sequence
  sgRNA
  Sele_7
atacgtcatgagctcactgg

SEQ ID NO: 52409 - DNA, 20 bp, Artificial Sequence
  sgRNA
  Sele_8
ggaacatttcctgataccgt

SEQ ID NO: 52410 - DNA, 20 bp, Artificial Sequence
  sgRNA
  Sele_9
gcagcatggagaccaccgtg

SEQ ID NO: 52411 - DNA, 20 bp, Artificial Sequence
  sgRNA
  Sele_10
attccaatccagtagtaact

SEQ ID NO: 52412 - DNA, 20 bp, Artificial Sequence
  sgRNA
  Sele_11
gcgcagataaggcttcacac

SEQ ID NO: 52413 - DNA, 20 bp, Artificial Sequence
  sgRNA
  Sele_12
gtagttgcactttctgcggc

SEQ ID NO: 52414 - DNA, 20 bp, Artificial Sequence
  sgRNA
  Sele_13
aagagcagagagaaagcgcg

SEQ ID NO: 52415 - DNA, 20 bp, Artificial Sequence
  sgRNA
  Sele_14
tccagaggacgtacaccgca

SEQ ID NO: 52416 - DNA, 20 bp, Artificial Sequence
  sgRNA
  Sele_15
ctgaactgctcccacccgtt

SEQ ID NO: 52417 - DNA, 20 bp, Artificial Sequence
  sgRNA
  Sele_16
ttatagctgaaggggccgaa

SEQ ID NO: 52418 - DNA, 20 bp, Artificial Sequence
  sgRNA
  Sele_17
tctggtggcaattcagaaca

SEQ ID NO: 52419 - DNA, 20 bp, Artificial Sequence
  sgRNA
  Sele_18
gagcagagtttcacgttgca

SEQ ID NO: 52420 - DNA, 20 bp, Artificial Sequence
  sgRNA
  Sele_19
gctttgacccaccctgccca

SEQ ID NO: 52421 - DNA, 20 bp, Artificial Sequence
  sgRNA
  Sele_20
ggatctgcagttctgacgtg

SEQ ID NO: 52422 - DNA, 20 bp, Artificial Sequence
  sgRNA
  Sell_1
tgacgcctgtcacaaacgaa

SEQ ID NO: 52423 - DNA, 20 bp, Artificial Sequence
  sgRNA
  Sell_2
gtccatggtacccaactcag

SEQ ID NO: 52424 - DNA, 20 bp, Artificial Sequence
  sgRNA
  Sell_3
acacgtgcatctgtgatgca

SEQ ID NO: 52425 - DNA, 20 bp, Artificial Sequence
  sgRNA
  Sell_4
ttctgaaaagcccatgaact

SEQ ID NO: 52426 - DNA, 20 bp, Artificial Sequence
  sgRNA
  Sell_5
tcatggtcaccgcattctcg

SEQ ID NO: 52427 - DNA, 20 bp, Artificial Sequence
  sgRNA
  Sell_6
ccagggtcttgcaatggccg

SEQ ID NO: 52428 - DNA, 20 bp, Artificial Sequence
  sgRNA
  Sell_7
ccacggccattgcaagaccc

SEQ ID NO: 52429 - DNA, 20 bp, Artificial Sequence
  sgRNA
  Sell_8
tcaaaactgcagcagactgt

SEQ ID NO: 52430 - DNA, 20 bp, Artificial Sequence
  sgRNA
  Sell_9
gtgtggagatctatatcaag

SEQ ID NO: 52431 - DNA, 20 bp, Artificial Sequence
  sgRNA
  Sell_10
tgtggagatctatatcaaga

SEQ ID NO: 52432 - DNA, 20 bp, Artificial Sequence
  sgRNA
  Sell_11
taagtaccctcacatctcca

SEQ ID NO: 52433 - DNA, 20 bp, Artificial Sequence
  sgRNA
  Sell_12
gacggctacaggaatgaaga

SEQ ID NO: 52434 - DNA, 20 bp, Artificial Sequence
  sgRNA
  Sell_13
cgagaatgcggtgaccatga

SEQ ID NO: 52435 - DNA, 20 bp, Artificial Sequence
  sgRNA
  Sell_14
tagtttccacacattctcca

SEQ ID NO: 52436 - DNA, 20 bp, Artificial Sequence
  sgRNA
  Sell_15
gggaaaatgtggacatgggt

SEQ ID NO: 52437 - DNA, 20 bp, Artificial Sequence
  sgRNA
  Sell_16
tctgtgatgcagggtattac

SEQ ID NO: 52438 - DNA, 20 bp, Artificial Sequence
  sgRNA
  Sell_17
acggctacaggaatgaagag

SEQ ID NO: 52439 - DNA, 20 bp, Artificial Sequence
  sgRNA
  Sell_18
agtttctcaaagatcaaaga

SEQ ID NO: 52440 - DNA, 20 bp, Artificial Sequence
  sgRNA
  Sell_19
cggctacaggaatgaagagg

SEQ ID NO: 52441 - DNA, 20 bp, Artificial Sequence
  sgRNA
  Sell_20
gcaagaccctggctggcaag

SEQ ID NO: 52442 - DNA, 20 bp, Artificial Sequence
  sgRNA
  Selp_1
atgtaccgtcacacttcggg

SEQ ID NO: 52443 - DNA, 20 bp, Artificial Sequence
  sgRNA
  Selp_2
gggaacaaataagacactca

SEQ ID NO: 52444 - DNA, 20 bp, Artificial Sequence
  sgRNA
  Selp_3
tggtacgtcaaggtaccgaa

SEQ ID NO: 52445 - DNA, 20 bp, Artificial Sequence
  sgRNA
  Selp_4
ttgtaggtggaattcccaag

SEQ ID NO: 52446 - DNA, 20 bp, Artificial Sequence
  sgRNA
  Selp_5
gtgaactgctcggatccctt

SEQ ID NO: 52447 - DNA, 20 bp, Artificial Sequence
  sgRNA
  Selp_6
gccagcctggatatagagcg

SEQ ID NO: 52448 - DNA, 20 bp, Artificial Sequence
  sgRNA
  Selp_7
atgtcctgccaacaccacct

SEQ ID NO: 52449 - DNA, 20 bp, Artificial Sequence
  sgRNA
  Selp_8
tggtctcgatgcactcccct

SEQ ID NO: 52450 - DNA, 20 bp, Artificial Sequence
  sgRNA
  Selp_9
tgtgagagcaacctgccgag

SEQ ID NO: 52451 - DNA, 20 bp, Artificial Sequence
  sgRNA
  Selp_10
attcccaagaggctgaacgc

SEQ ID NO: 52452 - DNA, 20 bp, Artificial Sequence
  sgRNA
  Selp_11
gttgaaggagaactccccca

SEQ ID NO: 52453 - DNA, 20 bp, Artificial Sequence
  sgRNA
  Selp_12
agttcatgagaacatgttga

SEQ ID NO: 52454 - DNA, 20 bp, Artificial Sequence
  sgRNA
  Selp_13
ttgaaggagaactcccccag

SEQ ID NO: 52455 - DNA, 20 bp, Artificial Sequence
  sgRNA
  Selp_14
gcagaggggttcgtgctgaa

SEQ ID NO: 52456 - DNA, 20 bp, Artificial Sequence
  sgRNA
  Selp_15
atacatctcccaacaaagcc

SEQ ID NO: 52457 - DNA, 20 bp, Artificial Sequence
  sgRNA
  Selp_16
agaatgggatgacgtcattg

SEQ ID NO: 52458 - DNA, 20 bp, Artificial Sequence
  sgRNA
  Selp_17
tcccatctacaggaaccttt

SEQ ID NO: 52459 - DNA, 20 bp, Artificial Sequence
  sgRNA
  Selp_18
ccatggatggggatctccgg

SEQ ID NO: 52460 - DNA, 20 bp, Artificial Sequence
  sgRNA
  Selp_19
tacatctcccaacaaagccg

SEQ ID NO: 52461 - DNA, 20 bp, Artificial Sequence
  sgRNA
  Selp_20
gggatccgagcagttcacct

SEQ ID NO: 52462 - DNA, 20 bp, Artificial Sequence
  sgRNA
  Selplg_1
tctctctagcatgaccacgg

SEQ ID NO: 52463 - DNA, 20 bp, Artificial Sequence
  sgRNA
  Selplg_2
tggttggacggtctctactg

SEQ ID NO: 52464 - DNA, 20 bp, Artificial Sequence
  sgRNA
  Selplg_3
ctgtgttatacgtatagtca

SEQ ID NO: 52465 - DNA, 20 bp, Artificial Sequence
  sgRNA
  Selplg_4
ctctcagccagcacccaacg

SEQ ID NO: 52466 - DNA, 20 bp, Artificial Sequence
  sgRNA
  Selplg_5
agatgcagatcatctccgtg

SEQ ID NO: 52467 - DNA, 20 bp, Artificial Sequence
  sgRNA
  Selplg_6
gagtctttctggagaacgca

SEQ ID NO: 52468 - DNA, 20 bp, Artificial Sequence
  sgRNA
  Selplg_7
gggcccctgtcacagccaat

SEQ ID NO: 52469 - DNA, 20 bp, Artificial Sequence
  sgRNA
  Selplg_8
atctctctctagcatgacca

SEQ ID NO: 52470 - DNA, 20 bp, Artificial Sequence
  sgRNA
  Selplg_9
agtgcggaactactccccca

SEQ ID NO: 52471 - DNA, 20 bp, Artificial Sequence
  sgRNA
  Selplg_10
ccagcaccactgtgcacacg

SEQ ID NO: 52472 - DNA, 20 bp, Artificial Sequence
  sgRNA
  Selplg_11
cgtccaaccagcatccacag

SEQ ID NO: 52473 - DNA, 20 bp, Artificial Sequence
  sgRNA
  Selplg_12
cctctcttaccgggttacca

SEQ ID NO: 52474 - DNA, 20 bp, Artificial Sequence
  sgRNA
  Selplg_13
gaaaaatgtcaccaacaccg

SEQ ID NO: 52475 - DNA, 20 bp, Artificial Sequence
  sgRNA
  Selplg_14
tcaggtaagtgagtcacgga

SEQ ID NO: 52476 - DNA, 20 bp, Artificial Sequence
  sgRNA
  Selplg_15
cgagatgcagatcatctccg

SEQ ID NO: 52477 - DNA, 20 bp, Artificial Sequence
  sgRNA
  Selplg_16
gggatgagatctgaactccc

SEQ ID NO: 52478 - DNA, 20 bp, Artificial Sequence
  sgRNA
  Selplg_17
ctgtgcatctccgggaacgg

SEQ ID NO: 52479 - DNA, 20 bp, Artificial Sequence
  sgRNA
  Selplg_18
tcgtccctgctacctgaggg

SEQ ID NO: 52480 - DNA, 20 bp, Artificial Sequence
  sgRNA
  Selplg_19
ccatggtaacccggtaagag

SEQ ID NO: 52481 - DNA, 20 bp, Artificial Sequence
  sgRNA
  Selplg_20
gcatgaaaccaaggaagccc

SEQ ID NO: 52482 - DNA, 20 bp, Artificial Sequence
  sgRNA
  Sema4a_1
aaagaagaaatagacgacct

SEQ ID NO: 52483 - DNA, 20 bp, Artificial Sequence
  sgRNA
  Sema4a_2
cagcagtgcttatctcgtgg

SEQ ID NO: 52484 - DNA, 20 bp, Artificial Sequence
  sgRNA
  Sema4a_3
gttgcccatcttgatagaca

SEQ ID NO: 52485 - DNA, 20 bp, Artificial Sequence
  sgRNA
  Sema4a_4
tggcaacactctctatgtgg

SEQ ID NO: 52486 - DNA, 20 bp, Artificial Sequence
  sgRNA
  Sema4a_5
gcagcgtgtcaaagtctcgg

SEQ ID NO: 52487 - DNA, 20 bp, Artificial Sequence
  sgRNA
  Sema4a_6
gctctcgtagacactgcaat

SEQ ID NO: 52488 - DNA, 20 bp, Artificial Sequence
  sgRNA
  Sema4a_7
acgcagtctttacctcccag

SEQ ID NO: 52489 - DNA, 20 bp, Artificial Sequence
  sgRNA
  Sema4a_8
agttgctctgcgctcagcca

SEQ ID NO: 52490 - DNA, 20 bp, Artificial Sequence
  sgRNA
  Sema4a_9
gccattgtagacggtagcag

SEQ ID NO: 52491 - DNA, 20 bp, Artificial Sequence
  sgRNA
  Sema4a_10
gagcactcccaggagcacga

SEQ ID NO: 52492 - DNA, 20 bp, Artificial Sequence
  sgRNA
  Sema4a_11
agactgacatcttcttacgc

SEQ ID NO: 52493 - DNA, 20 bp, Artificial Sequence
  sgRNA
  Sema4a_12
gctgaaggcaaaggtcccac

SEQ ID NO: 52494 - DNA, 20 bp, Artificial Sequence
  sgRNA
  Sema4a_13
tcccgctggaccacttaccg

SEQ ID NO: 52495 - DNA, 20 bp, Artificial Sequence
  sgRNA
  Sema4a_14
agtctggtgtggagtacaca

SEQ ID NO: 52496 - DNA, 20 bp, Artificial Sequence
  sgRNA
  Sema4a_15
agatgccgacaacaaccatc

SEQ ID NO: 52497 - DNA, 20 bp, Artificial Sequence
  sgRNA
  Sema4a_16
ggacatggaacgcggcaacc

SEQ ID NO: 52498 - DNA, 20 bp, Artificial Sequence
  sgRNA
  Sema4a_17
gtaggaccgctgggcagcca

SEQ ID NO: 52499 - DNA, 20 bp, Artificial Sequence
  sgRNA
  Sema4a_18
atcttggagttcctagaggg

SEQ ID NO: 52500 - DNA, 20 bp, Artificial Sequence
  sgRNA
  Sema4a_19
ataccctgtggtctcctatt

SEQ ID NO: 52501 - DNA, 20 bp, Artificial Sequence
  sgRNA
  Sema4a_20
cgttctcagtcgccacacac

SEQ ID NO: 52502 - DNA, 20 bp, Artificial Sequence
  sgRNA
  Sema4b_1
tcgggcaactcgggacacga

SEQ ID NO: 52503 - DNA, 20 bp, Artificial Sequence
  sgRNA
  Sema4b_2
ctactgatacctaccgctcc

SEQ ID NO: 52504 - DNA, 20 bp, Artificial Sequence
  sgRNA
  Sema4b_3
gggtcttgcgccaatcctga

SEQ ID NO: 52505 - DNA, 20 bp, Artificial Sequence
  sgRNA
  Sema4b_4
tccctcaactggctacaagg

SEQ ID NO: 52506 - DNA, 20 bp, Artificial Sequence
  sgRNA
  Sema4b_5
ggagggccgacaccattcag

SEQ ID NO: 52507 - DNA, 20 bp, Artificial Sequence
  sgRNA
  Sema4b_6
tgctgcggacgacgactacg

SEQ ID NO: 52508 - DNA, 20 bp, Artificial Sequence
  sgRNA
  Sema4b_7
ggtccccggtgggtaacacg

SEQ ID NO: 52509 - DNA, 20 bp, Artificial Sequence
  sgRNA
  Sema4b_8
gcctacgtccccgagagcct

SEQ ID NO: 52510 - DNA, 20 bp, Artificial Sequence
  sgRNA
  Sema4b_9
agcaccccacttgaccaccg

SEQ ID NO: 52511 - DNA, 20 bp, Artificial Sequence
  sgRNA
  Sema4b_10
ctgccgcgtgttacccaccg

SEQ ID NO: 52512 - DNA, 20 bp, Artificial Sequence
  sgRNA
  Sema4b_11
cctgagacccgaccgctgaa

SEQ ID NO: 52513 - DNA, 20 bp, Artificial Sequence
  sgRNA
  Sema4b_12
tgtggccagctactgcccag

SEQ ID NO: 52514 - DNA, 20 bp, Artificial Sequence
  sgRNA
  Sema4b_13
gtttcatgccatcccgatgt

SEQ ID NO: 52515 - DNA, 20 bp, Artificial Sequence
  sgRNA
  Sema4b_14
gctgcggacgacgactacgc

SEQ ID NO: 52516 - DNA, 20 bp, Artificial Sequence
  sgRNA
  Sema4b_15
gctctcggggacgtaggccg

SEQ ID NO: 52517 - DNA, 20 bp, Artificial Sequence
  sgRNA
  Sema4b_16
atgaaactcttcctaaagca

SEQ ID NO: 52518 - DNA, 20 bp, Artificial Sequence
  sgRNA
  Sema4b_17
gtacaggctgcagttggcta

SEQ ID NO: 52519 - DNA, 20 bp, Artificial Sequence
  sgRNA
  Sema4b_18
actcggctctgggtgcacaa

SEQ ID NO: 52520 - DNA, 20 bp, Artificial Sequence
  sgRNA
  Sema4b_19
cactcggtctgggagctgca

SEQ ID NO: 52521 - DNA, 20 bp, Artificial Sequence
  sgRNA
  Sema4b_20
ggttgggtacaggctgcagt

SEQ ID NO: 52522 - DNA, 20 bp, Artificial Sequence
  sgRNA
  Sema4c_1
gctcttctcgaagtcgccgg

SEQ ID NO: 52523 - DNA, 20 bp, Artificial Sequence
  sgRNA
  Sema4c_2
agctcgcggatgaattacga

SEQ ID NO: 52524 - DNA, 20 bp, Artificial Sequence
  sgRNA
  Sema4c_3
accctatcgttgctattcag

SEQ ID NO: 52525 - DNA, 20 bp, Artificial Sequence
  sgRNA
  Sema4c_4
gcacaacaccaccttcttcg

SEQ ID NO: 52526 - DNA, 20 bp, Artificial Sequence
  sgRNA
  Sema4c_5
tttatatgtgggggcccgag

SEQ ID NO: 52527 - DNA, 20 bp, Artificial Sequence
  sgRNA
  Sema4c_6
gagtcccgtgtcataaagaa

SEQ ID NO: 52528 - DNA, 20 bp, Artificial Sequence
  sgRNA
  Sema4c_7
tgcccatatgacccagctaa

SEQ ID NO: 52529 - DNA, 20 bp, Artificial Sequence
  sgRNA
  Sema4c_8
tgacattccaggcacagtaa

SEQ ID NO: 52530 - DNA, 20 bp, Artificial Sequence
  sgRNA
  Sema4c_9
tccgaatagtagtacccgac

SEQ ID NO: 52531 - DNA, 20 bp, Artificial Sequence
  sgRNA
  Sema4c_10
ggctggccaggtatgccagg

SEQ ID NO: 52532 - DNA, 20 bp, Artificial Sequence
  sgRNA
  Sema4c_11
agattgtgcctggtcacgcc

SEQ ID NO: 52533 - DNA, 20 bp, Artificial Sequence
  sgRNA
  Sema4c_12
gtcgggtactactattcgga

SEQ ID NO: 52534 - DNA, 20 bp, Artificial Sequence
  sgRNA
  Sema4c_13
ggtgccgcagacatacagat

SEQ ID NO: 52535 - DNA, 20 bp, Artificial Sequence
  sgRNA
  Sema4c_14
gtgttcttcttcacaagtag

SEQ ID NO: 52536 - DNA, 20 bp, Artificial Sequence
  sgRNA
  Sema4c_15
tctccaactcggctccacct

SEQ ID NO: 52537 - DNA, 20 bp, Artificial Sequence
  sgRNA
  Sema4c_16
tgttcttcttcacaagtagg

SEQ ID NO: 52538 - DNA, 20 bp, Artificial Sequence
  sgRNA
  Sema4c_17
ccagaagatactgtcttccg

SEQ ID NO: 52539 - DNA, 20 bp, Artificial Sequence
  sgRNA
  Sema4c_18
tggtggccgacagggtccca

SEQ ID NO: 52540 - DNA, 20 bp, Artificial Sequence
  sgRNA
  Sema4c_19
acagctgaaccagctgagag

SEQ ID NO: 52541 - DNA, 20 bp, Artificial Sequence
  sgRNA
  Sema4c_20
ggtcggaactcaaatgccaa

SEQ ID NO: 52542 - DNA, 20 bp, Artificial Sequence
  sgRNA
  Sema4d_1
gatggcatactccgtcctca

SEQ ID NO: 52543 - DNA, 20 bp, Artificial Sequence
  sgRNA
  Sema4d_2
ggctggattcaggacatgag

SEQ ID NO: 52544 - DNA, 20 bp, Artificial Sequence
  sgRNA
  Sema4d_3
cttgggtctgttgtctatcg

SEQ ID NO: 52545 - DNA, 20 bp, Artificial Sequence
  sgRNA
  Sema4d_4
attggtcccacacacataga

SEQ ID NO: 52546 - DNA, 20 bp, Artificial Sequence
  sgRNA
  Sema4d_5
tttcaagcacggcggcacag

SEQ ID NO: 52547 - DNA, 20 bp, Artificial Sequence
  sgRNA
  Sema4d_6
ctggcattctgcgaaaagca

SEQ ID NO: 52548 - DNA, 20 bp, Artificial Sequence
  sgRNA
  Sema4d_7
aaaagcccagatggtccgga

SEQ ID NO: 52549 - DNA, 20 bp, Artificial Sequence
  sgRNA
  Sema4d_8
ggacggagtatgccatcccg

SEQ ID NO: 52550 - DNA, 20 bp, Artificial Sequence
  sgRNA
  Sema4d_9
tgccggttgcatctacccag

SEQ ID NO: 52551 - DNA, 20 bp, Artificial Sequence
  sgRNA
  Sema4d_10
cctgctcatcttcaacctgt

SEQ ID NO: 52552 - DNA, 20 bp, Artificial Sequence
  sgRNA
  Sema4d_11
cttacggctgttgggccccg

SEQ ID NO: 52553 - DNA, 20 bp, Artificial Sequence
  sgRNA
  Sema4d_12
gcgagtcctcacgatccgtg

SEQ ID NO: 52554 - DNA, 20 bp, Artificial Sequence
  sgRNA
  Sema4d_13
agttcacacttgacatcaaa

SEQ ID NO: 52555 - DNA, 20 bp, Artificial Sequence
  sgRNA
  Sema4d_14
gaagacgaattcgtactcca

SEQ ID NO: 52556 - DNA, 20 bp, Artificial Sequence
  sgRNA
  Sema4d_15
ggttctcaacactaccacca

SEQ ID NO: 52557 - DNA, 20 bp, Artificial Sequence
  sgRNA
  Sema4d_16
cataggtacacacgtctcca

SEQ ID NO: 52558 - DNA, 20 bp, Artificial Sequence
  sgRNA
  Sema4d_17
ggaggttgcccacagagccg

SEQ ID NO: 52559 - DNA, 20 bp, Artificial Sequence
  sgRNA
  Sema4d_18
ggtagtgttgagaaccgcgg

SEQ ID NO: 52560 - DNA, 20 bp, Artificial Sequence
  sgRNA
  Sema4d_19
gatgatcccgcgagttgcca

SEQ ID NO: 52561 - DNA, 20 bp, Artificial Sequence
  sgRNA
  Sema4d_20
gatacaccgtcttctctgag

SEQ ID NO: 52562 - DNA, 20 bp, Artificial Sequence
  sgRNA
  Sema4f_1
gcacttcggatcaaaagcga

SEQ ID NO: 52563 - DNA, 20 bp, Artificial Sequence
  sgRNA
  Sema4f_2
gctaaaacatgactgcaaca

SEQ ID NO: 52564 - DNA, 20 bp, Artificial Sequence
  sgRNA
  Sema4f_3
gcttctcacacactttacgt

SEQ ID NO: 52565 - DNA, 20 bp, Artificial Sequence
  sgRNA
  Sema4f_4
catatcctgcagaacccccg

SEQ ID NO: 52566 - DNA, 20 bp, Artificial Sequence
  sgRNA
  Sema4f_5
gagatgctgctagaacaccc

SEQ ID NO: 52567 - DNA, 20 bp, Artificial Sequence
  sgRNA
  Sema4f_6
tgattggtcgccgtcagcag

SEQ ID NO: 52568 - DNA, 20 bp, Artificial Sequence
  sgRNA
  Sema4f_7
gctcaaaaggacatttcccc

SEQ ID NO: 52569 - DNA, 20 bp, Artificial Sequence
  sgRNA
  Sema4f_8
ataagcagccaccacacggg

SEQ ID NO: 52570 - DNA, 20 bp, Artificial Sequence
  sgRNA
  Sema4f_9
tacaatttcatgctttcaac

SEQ ID NO: 52571 - DNA, 20 bp, Artificial Sequence
  sgRNA
  Sema4f_10
gctataagcagccaccacac

SEQ ID NO: 52572 - DNA, 20 bp, Artificial Sequence
  sgRNA
  Sema4f_11
gctcatatgagtccaagact

SEQ ID NO: 52573 - DNA, 20 bp, Artificial Sequence
  sgRNA
  Sema4f_12
tatgcttgcgagtgtcagga

SEQ ID NO: 52574 - DNA, 20 bp, Artificial Sequence
  sgRNA
  Sema4f_13
agctataagcagccaccaca

SEQ ID NO: 52575 - DNA, 20 bp, Artificial Sequence
  sgRNA
  Sema4f_14
gcttcgacctcagcctggcg

SEQ ID NO: 52576 - DNA, 20 bp, Artificial Sequence
  sgRNA
  Sema4f_15
tgtggtggctgcttatagct

SEQ ID NO: 52577 - DNA, 20 bp, Artificial Sequence
  sgRNA
  Sema4f_16
ggatgcccaggcagaactgg

SEQ ID NO: 52578 - DNA, 20 bp, Artificial Sequence
  sgRNA
  Sema4f_17
tcaacggtcagcagctgtaa

SEQ ID NO: 52579 - DNA, 20 bp, Artificial Sequence
  sgRNA
  Sema4f_18
catagctgcgacaaaggctg

SEQ ID NO: 52580 - DNA, 20 bp, Artificial Sequence
  sgRNA
  Sema4f_19
gagatggacgacgtttctaa

SEQ ID NO: 52581 - DNA, 20 bp, Artificial Sequence
  sgRNA
  Sema4f_20
accactgccccgcttaccca

SEQ ID NO: 52582 - DNA, 20 bp, Artificial Sequence
  sgRNA
  Sema4g_1
acagtatgagacactacgtg

SEQ ID NO: 52583 - DNA, 20 bp, Artificial Sequence
  sgRNA
  Sema4g_2
gccgctgtagaaatcgcacg

SEQ ID NO: 52584 - DNA, 20 bp, Artificial Sequence
  sgRNA
  Sema4g_3
agaaagagcaggtcataggt

SEQ ID NO: 52585 - DNA, 20 bp, Artificial Sequence
  sgRNA
  Sema4g_4
ggagaaatgtccttatgacc

SEQ ID NO: 52586 - DNA, 20 bp, Artificial Sequence
  sgRNA
  Sema4g_5
gctccggaattcataccggg

SEQ ID NO: 52587 - DNA, 20 bp, Artificial Sequence
  sgRNA
  Sema4g_6
accacgtgcgatttctacag

SEQ ID NO: 52588 - DNA, 20 bp, Artificial Sequence
  sgRNA
  Sema4g_7
ctgcctccagatcattcccg

SEQ ID NO: 52589 - DNA, 20 bp, Artificial Sequence
  sgRNA
  Sema4g_8
gagagctagatgccacccca

SEQ ID NO: 52590 - DNA, 20 bp, Artificial Sequence
  sgRNA
  Sema4g_9
aagacccgatctgtgctccg

SEQ ID NO: 52591 - DNA, 20 bp, Artificial Sequence
  sgRNA
  Sema4g_10
ggagcattcctgatatccgc

SEQ ID NO: 52592 - DNA, 20 bp, Artificial Sequence
  sgRNA
  Sema4g_11
gggctactctagccacacgg

SEQ ID NO: 52593 - DNA, 20 bp, Artificial Sequence
  sgRNA
  Sema4g_12
gcagcccatccactcccacg

SEQ ID NO: 52594 - DNA, 20 bp, Artificial Sequence
  sgRNA
  Sema4g_13
tcataggagatggtcagccg

SEQ ID NO: 52595 - DNA, 20 bp, Artificial Sequence
  sgRNA
  Sema4g_14
gcaggaggacatcatcaccc

SEQ ID NO: 52596 - DNA, 20 bp, Artificial Sequence
  sgRNA
  Sema4g_15
gaatctcagccaggtcatag

SEQ ID NO: 52597 - DNA, 20 bp, Artificial Sequence
  sgRNA
  Sema4g_16
tttccctcctcgaaactagt

SEQ ID NO: 52598 - DNA, 20 bp, Artificial Sequence
  sgRNA
  Sema4g_17
acagattcattgcgcagccg

SEQ ID NO: 52599 - DNA, 20 bp, Artificial Sequence
  sgRNA
  Sema4g_18
tgtccttatgacccggcccg

SEQ ID NO: 52600 - DNA, 20 bp, Artificial Sequence
  sgRNA
  Sema4g_19
cagacaagccacatagagga

SEQ ID NO: 52601 - DNA, 20 bp, Artificial Sequence
  sgRNA
  Sema4g_20
actagattgtccacagactg

SEQ ID NO: 52602 - DNA, 20 bp, Artificial Sequence
  sgRNA
  Sema5a_1
cttcttccgagaaaacgccg

SEQ ID NO: 52603 - DNA, 20 bp, Artificial Sequence
  sgRNA
  Sema5a_2
aagaacttgtcgtaggagcg

SEQ ID NO: 52604 - DNA, 20 bp, Artificial Sequence
  sgRNA
  Sema5a_3
tgactgtgcaggatgcaatg

SEQ ID NO: 52605 - DNA, 20 bp, Artificial Sequence
  sgRNA
  Sema5a_4
gccacttccatcaaacacgc

SEQ ID NO: 52606 - DNA, 20 bp, Artificial Sequence
  sgRNA
  Sema5a_5
gctctgaactcccgtaacca

SEQ ID NO: 52607 - DNA, 20 bp, Artificial Sequence
  sgRNA
  Sema5a_6
ggacagaaagaacttgtcgt

SEQ ID NO: 52608 - DNA, 20 bp, Artificial Sequence
  sgRNA
  Sema5a_7
gttgaggcgagccttcatga

SEQ ID NO: 52609 - DNA, 20 bp, Artificial Sequence
  sgRNA
  Sema5a_8
tgttccacatgatggccgtg

SEQ ID NO: 52610 - DNA, 20 bp, Artificial Sequence
  sgRNA
  Sema5a_9
agatcagatccagctccggc

SEQ ID NO: 52611 - DNA, 20 bp, Artificial Sequence
  sgRNA
  Sema5a_10
aatggaactgctaagcccca

SEQ ID NO: 52612 - DNA, 20 bp, Artificial Sequence
  sgRNA
  Sema5a_11
gctctatgctgcaacagcca

SEQ ID NO: 52613 - DNA, 20 bp, Artificial Sequence
  sgRNA
  Sema5a_12
caacagccatggatttccca

SEQ ID NO: 52614 - DNA, 20 bp, Artificial Sequence
  sgRNA
  Sema5a_13
ccatagatcagatccagctc

SEQ ID NO: 52615 - DNA, 20 bp, Artificial Sequence
  sgRNA
  Sema5a_14
gctgtaacaggccttcttgg

SEQ ID NO: 52616 - DNA, 20 bp, Artificial Sequence
  sgRNA
  Sema5a_15
tgtgaaggcattggtcccac

SEQ ID NO: 52617 - DNA, 20 bp, Artificial Sequence
  sgRNA
  Sema5a_16
ttgtctacacctactgccag

SEQ ID NO: 52618 - DNA, 20 bp, Artificial Sequence
  sgRNA
  Sema5a_17
tgaacttctgagcatcctgt

SEQ ID NO: 52619 - DNA, 20 bp, Artificial Sequence
  sgRNA
  Sema5a_18
agaatgctgtggatttctcg

SEQ ID NO: 52620 - DNA, 20 bp, Artificial Sequence
  sgRNA
  Sema5a_19
ggacaaatatgattctgtgg

SEQ ID NO: 52621 - DNA, 20 bp, Artificial Sequence
  sgRNA
  Sema5a_20
gcatggctgttctcaagcct

SEQ ID NO: 52622 - DNA, 20 bp, Artificial Sequence
  sgRNA
  Sema5b_1
gttcggcctatcatagccag

SEQ ID NO: 52623 - DNA, 20 bp, Artificial Sequence
  sgRNA
  Sema5b_2
ttatactgggcagtgcgaag

SEQ ID NO: 52624 - DNA, 20 bp, Artificial Sequence
  sgRNA
  Sema5b_3
ccagagcaaagggaaaacgg

SEQ ID NO: 52625 - DNA, 20 bp, Artificial Sequence
  sgRNA
  Sema5b_4
ctctatcacgtactctacat

SEQ ID NO: 52626 - DNA, 20 bp, Artificial Sequence
  sgRNA
  Sema5b_5
gcacatgaacaccttccggc

SEQ ID NO: 52627 - DNA, 20 bp, Artificial Sequence
  sgRNA
  Sema5b_6
tcacgtactctacataggca

SEQ ID NO: 52628 - DNA, 20 bp, Artificial Sequence
  sgRNA
  Sema5b_7
tcaccacacactctgaacgg

SEQ ID NO: 52629 - DNA, 20 bp, Artificial Sequence
  sgRNA
  Sema5b_8
acgatgagctgattcctcga

SEQ ID NO: 52630 - DNA, 20 bp, Artificial Sequence
  sgRNA
  Sema5b_9
gcgcactgtgtactctcggg

SEQ ID NO: 52631 - DNA, 20 bp, Artificial Sequence
  sgRNA
  Sema5b_10
cctgattgtttccggccgga

SEQ ID NO: 52632 - DNA, 20 bp, Artificial Sequence
  sgRNA
  Sema5b_11
gcgcccacaatcatgctcca

SEQ ID NO: 52633 - DNA, 20 bp, Artificial Sequence
  sgRNA
  Sema5b_12
agcttgctcttgatccctcg

SEQ ID NO: 52634 - DNA, 20 bp, Artificial Sequence
  sgRNA
  Sema5b_13
gctgcccgtgaacgtgaccc

SEQ ID NO: 52635 - DNA, 20 bp, Artificial Sequence
  sgRNA
  Sema5b_14
tcgttaccaggaaaacccca

SEQ ID NO: 52636 - DNA, 20 bp, Artificial Sequence
  sgRNA
  Sema5b_15
gcacttccgggcaagcctcg

SEQ ID NO: 52637 - DNA, 20 bp, Artificial Sequence
  sgRNA
  Sema5b_16
cctcctccgtgtgcaggccg

SEQ ID NO: 52638 - DNA, 20 bp, Artificial Sequence
  sgRNA
  Sema5b_17
acggctgtagagttgtggcg

SEQ ID NO: 52639 - DNA, 20 bp, Artificial Sequence
  sgRNA
  Sema5b_18
gcgctccgtgaggttctcgt

SEQ ID NO: 52640 - DNA, 20 bp, Artificial Sequence
  sgRNA
  Sema5b_19
ggttgctgcaacttcgctga

SEQ ID NO: 52641 - DNA, 20 bp, Artificial Sequence
  sgRNA
  Sema5b_20
accaacccggagcctcgcaa

SEQ ID NO: 52642 - DNA, 20 bp, Artificial Sequence
  sgRNA
  Sema6a_1
ggatgccgaatctgacgtag

SEQ ID NO: 52643 - DNA, 20 bp, Artificial Sequence
  sgRNA
  Sema6a_2
cttaccgagcagcaacgtag

SEQ ID NO: 52644 - DNA, 20 bp, Artificial Sequence
  sgRNA
  Sema6a_3
gacgcatccactcatggacg

SEQ ID NO: 52645 - DNA, 20 bp, Artificial Sequence
  sgRNA
  Sema6a_4
gatgatacgctgtttgtctg

SEQ ID NO: 52646 - DNA, 20 bp, Artificial Sequence
  sgRNA
  Sema6a_5
ggtacatctggctttagcga

SEQ ID NO: 52647 - DNA, 20 bp, Artificial Sequence
  sgRNA
  Sema6a_6
tctcccactcgcgactgccg

SEQ ID NO: 52648 - DNA, 20 bp, Artificial Sequence
  sgRNA
  Sema6a_7
cctatgggctcgaatataag

SEQ ID NO: 52649 - DNA, 20 bp, Artificial Sequence
  sgRNA
  Sema6a_8
cctcttatattcgagcccat

SEQ ID NO: 52650 - DNA, 20 bp, Artificial Sequence
  sgRNA
  Sema6a_9
ctactgccacgtctttgcgc

SEQ ID NO: 52651 - DNA, 20 bp, Artificial Sequence
  sgRNA
  Sema6a_10
gggtacatctggctttagcg

SEQ ID NO: 52652 - DNA, 20 bp, Artificial Sequence
  sgRNA
  Sema6a_11
gtacatctggctttagcgag

SEQ ID NO: 52653 - DNA, 20 bp, Artificial Sequence
  sgRNA
  Sema6a_12
atcatgcttgacagtcctga

SEQ ID NO: 52654 - DNA, 20 bp, Artificial Sequence
  sgRNA
  Sema6a_13
tttgagcaggacattgagcg

SEQ ID NO: 52655 - DNA, 20 bp, Artificial Sequence
  sgRNA
  Sema6a_14
agatcagcccaaaatgagcg

SEQ ID NO: 52656 - DNA, 20 bp, Artificial Sequence
  sgRNA
  Sema6a_15
ggtatcatcgggaaactcat

SEQ ID NO: 52657 - DNA, 20 bp, Artificial Sequence
  sgRNA
  Sema6a_16
ccctaaagttccacagcgcg

SEQ ID NO: 52658 - DNA, 20 bp, Artificial Sequence
  sgRNA
  Sema6a_17
atgcctacaactcactgacg

SEQ ID NO: 52659 - DNA, 20 bp, Artificial Sequence
  sgRNA
  Sema6a_18
aggaaccagagctttggccg

SEQ ID NO: 52660 - DNA, 20 bp, Artificial Sequence
  sgRNA
  Sema6a_19
aagagctcactcactcgcgt

SEQ ID NO: 52661 - DNA, 20 bp, Artificial Sequence
  sgRNA
  Sema6a_20
acaactcactgacgaggtcg

SEQ ID NO: 52662 - DNA, 20 bp, Artificial Sequence
  sgRNA
  Sema6b_1
ggagccgcacacgaacagcg

SEQ ID NO: 52663 - DNA, 20 bp, Artificial Sequence
  sgRNA
  Sema6b_2
gtttgagcaagatgtgtccg

SEQ ID NO: 52664 - DNA, 20 bp, Artificial Sequence
  sgRNA
  Sema6b_3
gcctggtcgtctgaccgctg

SEQ ID NO: 52665 - DNA, 20 bp, Artificial Sequence
  sgRNA
  Sema6b_4
caaagttgaggatctcgtca

SEQ ID NO: 52666 - DNA, 20 bp, Artificial Sequence
  sgRNA
  Sema6b_5
agaaccacctccactcagcg

SEQ ID NO: 52667 - DNA, 20 bp, Artificial Sequence
  sgRNA
  Sema6b_6
ggtcgtctgaccgctgcgga

SEQ ID NO: 52668 - DNA, 20 bp, Artificial Sequence
  sgRNA
  Sema6b_7
gccctgcgcggtcatctgag

SEQ ID NO: 52669 - DNA, 20 bp, Artificial Sequence
  sgRNA
  Sema6b_8
tcgcccaccgaagggtccaa

SEQ ID NO: 52670 - DNA, 20 bp, Artificial Sequence
  sgRNA
  Sema6b_9
gcctctcagatgaccgcgca

SEQ ID NO: 52671 - DNA, 20 bp, Artificial Sequence
  sgRNA
  Sema6b_10
actattgtctgattgcccca

SEQ ID NO: 52672 - DNA, 20 bp, Artificial Sequence
  sgRNA
  Sema6b_11
ggattgtgagaactctgatg

SEQ ID NO: 52673 - DNA, 20 bp, Artificial Sequence
  sgRNA
  Sema6b_12
cagtaaagcacgactccaag

SEQ ID NO: 52674 - DNA, 20 bp, Artificial Sequence
  sgRNA
  Sema6b_13
gccccgtgtccaggtcgtga

SEQ ID NO: 52675 - DNA, 20 bp, Artificial Sequence
  sgRNA
  Sema6b_14
ggacacatcttgctcaaacg

SEQ ID NO: 52676 - DNA, 20 bp, Artificial Sequence
  sgRNA
  Sema6b_15
ggctaggaagtcagtcaccg

SEQ ID NO: 52677 - DNA, 20 bp, Artificial Sequence
  sgRNA
  Sema6b_16
gctcaactgctcagtgccag

SEQ ID NO: 52678 - DNA, 20 bp, Artificial Sequence
  sgRNA
  Sema6b_17
ccacggagctgcgatatcag

SEQ ID NO: 52679 - DNA, 20 bp, Artificial Sequence
  sgRNA
  Sema6b_18
ccacgcccgtcacagcctgc

SEQ ID NO: 52680 - DNA, 20 bp, Artificial Sequence
  sgRNA
  Sema6b_19
gaggccattctggcgcacgg

SEQ ID NO: 52681 - DNA, 20 bp, Artificial Sequence
  sgRNA
  Sema6b_20
gcgtgagcgggaagtcgcct

SEQ ID NO: 52682 - DNA, 20 bp, Artificial Sequence
  sgRNA
  Sema6c_1
tccaacgcatagacaaagtg

SEQ ID NO: 52683 - DNA, 20 bp, Artificial Sequence
  sgRNA
  Sema6c_2
agttccagggaacaagaaca

SEQ ID NO: 52684 - DNA, 20 bp, Artificial Sequence
  sgRNA
  Sema6c_3
tgtggatggcatcgatccag

SEQ ID NO: 52685 - DNA, 20 bp, Artificial Sequence
  sgRNA
  Sema6c_4
tggcatcaaattaggtgcag

SEQ ID NO: 52686 - DNA, 20 bp, Artificial Sequence
  sgRNA
  Sema6c_5
gctggagtccacgaacagcg

SEQ ID NO: 52687 - DNA, 20 bp, Artificial Sequence
  sgRNA
  Sema6c_6
cgatgtccttgctccgacgg

SEQ ID NO: 52688 - DNA, 20 bp, Artificial Sequence
  sgRNA
  Sema6c_7
gcagcgcgcttgccttcggg

SEQ ID NO: 52689 - DNA, 20 bp, Artificial Sequence
  sgRNA
  Sema6c_8
ggtggcacgtcgagcctgag

SEQ ID NO: 52690 - DNA, 20 bp, Artificial Sequence
  sgRNA
  Sema6c_9
agaagtgtctgcgagttcca

SEQ ID NO: 52691 - DNA, 20 bp, Artificial Sequence
  sgRNA
  Sema6c_10
ggttcgctacccttcctggg

SEQ ID NO: 52692 - DNA, 20 bp, Artificial Sequence
  sgRNA
  Sema6c_11
gcttctctggacccatactg

SEQ ID NO: 52693 - DNA, 20 bp, Artificial Sequence
  sgRNA
  Sema6c_12
gattgccctttcccacacac

SEQ ID NO: 52694 - DNA, 20 bp, Artificial Sequence
  sgRNA
  Sema6c_13
gagctgcgcggcggatcata

SEQ ID NO: 52695 - DNA, 20 bp, Artificial Sequence
  sgRNA
  Sema6c_14
ataacatctctgcaacagga

SEQ ID NO: 52696 - DNA, 20 bp, Artificial Sequence
  sgRNA
  Sema6c_15
agtgaagaccccaaagagag

SEQ ID NO: 52697 - DNA, 20 bp, Artificial Sequence
  sgRNA
  Sema6c_16
gttgagcctcagcttaagga

SEQ ID NO: 52698 - DNA, 20 bp, Artificial Sequence
  sgRNA
  Sema6c_17
ctgaaggtgctacctccagg

SEQ ID NO: 52699 - DNA, 20 bp, Artificial Sequence
  sgRNA
  Sema6c_18
catgtcacgtttacataccc

SEQ ID NO: 52700 - DNA, 20 bp, Artificial Sequence
  sgRNA
  Sema6c_19
gttgaaatgaccaccgtgcg

SEQ ID NO: 52701 - DNA, 20 bp, Artificial Sequence
  sgRNA
  Sema6c_20
gcaaggacatcgagaccccg

SEQ ID NO: 52702 - DNA, 20 bp, Artificial Sequence
  sgRNA
  Sema6d_1
acgatccgtagcgctcacag

SEQ ID NO: 52703 - DNA, 20 bp, Artificial Sequence
  sgRNA
  Sema6d_2
gcaggctgtgtattcccgcg

SEQ ID NO: 52704 - DNA, 20 bp, Artificial Sequence
  sgRNA
  Sema6d_3
gcttaatctagaagctgacg

SEQ ID NO: 52705 - DNA, 20 bp, Artificial Sequence
  sgRNA
  Sema6d_4
tcttccgaacgaacatgtca

SEQ ID NO: 52706 - DNA, 20 bp, Artificial Sequence
  sgRNA
  Sema6d_5
tctggtctccaggttacggg

SEQ ID NO: 52707 - DNA, 20 bp, Artificial Sequence
  sgRNA
  Sema6d_6
acagcaacctgctgaccagt

SEQ ID NO: 52708 - DNA, 20 bp, Artificial Sequence
  sgRNA
  Sema6d_7
ggacttccttccttaaggct

SEQ ID NO: 52709 - DNA, 20 bp, Artificial Sequence
  sgRNA
  Sema6d_8
cttcttcagagaaatcgccg

SEQ ID NO: 52710 - DNA, 20 bp, Artificial Sequence
  sgRNA
  Sema6d_9
gctaccgtgacatgttcgtt

SEQ ID NO: 52711 - DNA, 20 bp, Artificial Sequence
  sgRNA
  Sema6d_10
agacagccgagtatgaaccg

SEQ ID NO: 52712 - DNA, 20 bp, Artificial Sequence
  sgRNA
  Sema6d_11
gttcagccgagccttaagga

SEQ ID NO: 52713 - DNA, 20 bp, Artificial Sequence
  sgRNA
  Sema6d_12
ggatcaccatgctttatacg

SEQ ID NO: 52714 - DNA, 20 bp, Artificial Sequence
  sgRNA
  Sema6d_13
ggatacaaagtccatggccg

SEQ ID NO: 52715 - DNA, 20 bp, Artificial Sequence
  sgRNA
  Sema6d_14
acccaaggtccctaaccggg

SEQ ID NO: 52716 - DNA, 20 bp, Artificial Sequence
  sgRNA
  Sema6d_15
agatatagagtgcctctggg

SEQ ID NO: 52717 - DNA, 20 bp, Artificial Sequence
  sgRNA
  Sema6d_16
acagacataatccaaatcaa

SEQ ID NO: 52718 - DNA, 20 bp, Artificial Sequence
  sgRNA
  Sema6d_17
tgtcctgctcatatcctcca

SEQ ID NO: 52719 - DNA, 20 bp, Artificial Sequence
  sgRNA
  Sema6d_18
ggtgtcatctggaaagtcga

SEQ ID NO: 52720 - DNA, 20 bp, Artificial Sequence
  sgRNA
  Sema6d_19
gactttgtatccgtgtttgg

SEQ ID NO: 52721 - DNA, 20 bp, Artificial Sequence
  sgRNA
  Sema6d_20
cagtcgtgcacagactccag

SEQ ID NO: 52722 - DNA, 20 bp, Artificial Sequence
  sgRNA
  Sema7a_1
cctcggtttcgacgcattcg

SEQ ID NO: 52723 - DNA, 20 bp, Artificial Sequence
  sgRNA
  Sema7a_2
tggtacttagaatggaacaa

SEQ ID NO: 52724 - DNA, 20 bp, Artificial Sequence
  sgRNA
  Sema7a_3
ggtgaacatcggctccacaa

SEQ ID NO: 52725 - DNA, 20 bp, Artificial Sequence
  sgRNA
  Sema7a_4
acaacgaactctcaccaccc

SEQ ID NO: 52726 - DNA, 20 bp, Artificial Sequence
  sgRNA
  Sema7a_5
gtatggccactaccgctgcg

SEQ ID NO: 52727 - DNA, 20 bp, Artificial Sequence
  sgRNA
  Sema7a_6
gttgtattcctgcttccgga

SEQ ID NO: 52728 - DNA, 20 bp, Artificial Sequence
  sgRNA
  Sema7a_7
gcagcgatgcagccaccaac

SEQ ID NO: 52729 - DNA, 20 bp, Artificial Sequence
  sgRNA
  Sema7a_8
ctaccacttcaacttccccg

SEQ ID NO: 52730 - DNA, 20 bp, Artificial Sequence
  sgRNA
  Sema7a_9
agagggctcctacctccgtg

SEQ ID NO: 52731 - DNA, 20 bp, Artificial Sequence
  sgRNA
  Sema7a_10
gtatcgagagttccgagcca

SEQ ID NO: 52732 - DNA, 20 bp, Artificial Sequence
  sgRNA
  Sema7a_11
ccaccaacaggaacttcaat

SEQ ID NO: 52733 - DNA, 20 bp, Artificial Sequence
  sgRNA
  Sema7a_12
tagcctggatggccgctgca

SEQ ID NO: 52734 - DNA, 20 bp, Artificial Sequence
  sgRNA
  Sema7a_13
gctctatgtgacctcccagt

SEQ ID NO: 52735 - DNA, 20 bp, Artificial Sequence
  sgRNA
  Sema7a_14
caaccctgacaagaaccccg

SEQ ID NO: 52736 - DNA, 20 bp, Artificial Sequence
  sgRNA
  Sema7a_15
taccacttcaacttccccga

SEQ ID NO: 52737 - DNA, 20 bp, Artificial Sequence
  sgRNA
  Sema7a_16
gcactggccgaacaactaat

SEQ ID NO: 52738 - DNA, 20 bp, Artificial Sequence
  sgRNA
  Sema7a_17
aatacaacgggaagatccct

SEQ ID NO: 52739 - DNA, 20 bp, Artificial Sequence
  sgRNA
  Sema7a_18
gtgaacatcggctccacaaa

SEQ ID NO: 52740 - DNA, 20 bp, Artificial Sequence
  sgRNA
  Sema7a_19
ccccgaatgcgtcgaaaccg

SEQ ID NO: 52741 - DNA, 20 bp, Artificial Sequence
  sgRNA
  Sema7a_20
gtacctggctcacttcccac

SEQ ID NO: 52742 - DNA, 20 bp, Artificial Sequence
  sgRNA
  Serinc1_1
gggcagaatggacattactg

SEQ ID NO: 52743 - DNA, 20 bp, Artificial Sequence
  sgRNA
  Serinc1_2
tagccaaccaggatattaca

SEQ ID NO: 52744 - DNA, 20 bp, Artificial Sequence
  sgRNA
  Serinc1_3
gtagatcaatctagtcacag

SEQ ID NO: 52745 - DNA, 20 bp, Artificial Sequence
  sgRNA
  Serinc1_4
tctacacaatgtatttgaca

SEQ ID NO: 52746 - DNA, 20 bp, Artificial Sequence
  sgRNA
  Serinc1_5
tctcgttatctacagctcgg

SEQ ID NO: 52747 - DNA, 20 bp, Artificial Sequence
  sgRNA
  Serinc1_6
tcattggcttcaataccaca

SEQ ID NO: 52748 - DNA, 20 bp, Artificial Sequence
  sgRNA
  Serinc1_7
accgagctgtagataacgag

SEQ ID NO: 52749 - DNA, 20 bp, Artificial Sequence
  sgRNA
  Serinc1_8
gcatcggcacagcaaacacg

SEQ ID NO: 52750 - DNA, 20 bp, Artificial Sequence
  sgRNA
  Serinc1_9
ttactgaggcgccaatgcag

SEQ ID NO: 52751 - DNA, 20 bp, Artificial Sequence
  sgRNA
  Serinc1_10
gtagacaaagaatagcacga

SEQ ID NO: 52752 - DNA, 20 bp, Artificial Sequence
  sgRNA
  Serinc1_11
acatggccaaaccaaagcac

SEQ ID NO: 52753 - DNA, 20 bp, Artificial Sequence
  sgRNA
  Serinc1_12
gctgtacgtgtggacactag

SEQ ID NO: 52754 - DNA, 20 bp, Artificial Sequence
  sgRNA
  Serinc1_13
agtgacggatcactagatga

SEQ ID NO: 52755 - DNA, 20 bp, Artificial Sequence
  sgRNA
  Serinc1_14
ttctcattctcacagaaccc

SEQ ID NO: 52756 - DNA, 20 bp, Artificial Sequence
  sgRNA
  Serinc1_15
ggcgcattcttcatcccaga

SEQ ID NO: 52757 - DNA, 20 bp, Artificial Sequence
  sgRNA
  Serinc1_16
ccttgatcattagtaaagag

SEQ ID NO: 52758 - DNA, 20 bp, Artificial Sequence
  sgRNA
  Serinc1_17
gcttgtgtaatgttaatacc

SEQ ID NO: 52759 - DNA, 20 bp, Artificial Sequence
  sgRNA
  Serinc1_18
ccgagctgtagataacgaga

SEQ ID NO: 52760 - DNA, 20 bp, Artificial Sequence
  sgRNA
  Serinc1_19
atacctgtaccaattggtga

SEQ ID NO: 52761 - DNA, 20 bp, Artificial Sequence
  sgRNA
  Serinc1_20
aagcagcagtgaccctagag

SEQ ID NO: 52762 - DNA, 20 bp, Artificial Sequence
  sgRNA
  Serinc2_1
agcacatacggtagacagcg

SEQ ID NO: 52763 - DNA, 20 bp, Artificial Sequence
  sgRNA
  Serinc2_2
tgtatacaaggttatgacgg

SEQ ID NO: 52764 - DNA, 20 bp, Artificial Sequence
  sgRNA
  Serinc2_3
atggctcctttcccaagagt

SEQ ID NO: 52765 - DNA, 20 bp, Artificial Sequence
  sgRNA
  Serinc2_4
tctgcaccctgcatcctatg

SEQ ID NO: 52766 - DNA, 20 bp, Artificial Sequence
  sgRNA
  Serinc2_5
gcgatcctctgaccaccgtc

SEQ ID NO: 52767 - DNA, 20 bp, Artificial Sequence
  sgRNA
  Serinc2_6
gcggtggctgtgtaaggccg

SEQ ID NO: 52768 - DNA, 20 bp, Artificial Sequence
  sgRNA
  Serinc2_7
tcatgatgacgcttaccaac

SEQ ID NO: 52769 - DNA, 20 bp, Artificial Sequence
  sgRNA
  Serinc2_8
gtcctgtcctcacacaccca

SEQ ID NO: 52770 - DNA, 20 bp, Artificial Sequence
  sgRNA
  Serinc2_9
actgatgttcgtctactaca

SEQ ID NO: 52771 - DNA, 20 bp, Artificial Sequence
  sgRNA
  Serinc2_10
cccactcctggaatcagcgg

SEQ ID NO: 52772 - DNA, 20 bp, Artificial Sequence
  sgRNA
  Serinc2_11
ttgcccactcctggaatcag

SEQ ID NO: 52773 - DNA, 20 bp, Artificial Sequence
  sgRNA
  Serinc2_12
tgcacaggatgaagatgacg

SEQ ID NO: 52774 - DNA, 20 bp, Artificial Sequence
  sgRNA
  Serinc2_13
cctcacctgcccactaaaaa

SEQ ID NO: 52775 - DNA, 20 bp, Artificial Sequence
  sgRNA
  Serinc2_14
gatccttgtgggtatcactg

SEQ ID NO: 52776 - DNA, 20 bp, Artificial Sequence
  sgRNA
  Serinc2_15
tcatcttccgggtctctcca

SEQ ID NO: 52777 - DNA, 20 bp, Artificial Sequence
  sgRNA
  Serinc2_16
agatctgtgccagctgggcg

SEQ ID NO: 52778 - DNA, 20 bp, Artificial Sequence
  sgRNA
  Serinc2_17
gaacagcctgatgcagacag

SEQ ID NO: 52779 - DNA, 20 bp, Artificial Sequence
  sgRNA
  Serinc2_18
gcatcaggctgttcacctga

SEQ ID NO: 52780 - DNA, 20 bp, Artificial Sequence
  sgRNA
  Serinc2_19
ggtcctgtcctcacacaccc

SEQ ID NO: 52781 - DNA, 20 bp, Artificial Sequence
  sgRNA
  Serinc2_20
tcaggctgttcacctgacgg

SEQ ID NO: 52782 - DNA, 20 bp, Artificial Sequence
  sgRNA
  Serinc3_1
gtgatgatgctcataaggga

SEQ ID NO: 52783 - DNA, 20 bp, Artificial Sequence
  sgRNA
  Serinc3_2
gtagatgagccgagttacag

SEQ ID NO: 52784 - DNA, 20 bp, Artificial Sequence
  sgRNA
  Serinc3_3
tccatacctgaactttaggg

SEQ ID NO: 52785 - DNA, 20 bp, Artificial Sequence
  sgRNA
  Serinc3_4
aggaggatttcaaatcaaga

SEQ ID NO: 52786 - DNA, 20 bp, Artificial Sequence
  sgRNA
  Serinc3_5
gacatgatgcaccactacag

SEQ ID NO: 52787 - DNA, 20 bp, Artificial Sequence
  sgRNA
  Serinc3_6
attatgggtaaatcgaatgg

SEQ ID NO: 52788 - DNA, 20 bp, Artificial Sequence
  sgRNA
  Serinc3_7
tcattgtctacagccctccg

SEQ ID NO: 52789 - DNA, 20 bp, Artificial Sequence
  sgRNA
  Serinc3_8
agaggatggacagccacgga

SEQ ID NO: 52790 - DNA, 20 bp, Artificial Sequence
  sgRNA
  Serinc3_9
gctgtagacaatgagaagga

SEQ ID NO: 52791 - DNA, 20 bp, Artificial Sequence
  sgRNA
  Serinc3_10
ctagctgtgtggttcaaaat

SEQ ID NO: 52792 - DNA, 20 bp, Artificial Sequence
  sgRNA
  Serinc3_11
gtatcggatcaactttgctg

SEQ ID NO: 52793 - DNA, 20 bp, Artificial Sequence
  sgRNA
  Serinc3_12
gagcagcgcagcaaagacga

SEQ ID NO: 52794 - DNA, 20 bp, Artificial Sequence
  sgRNA
  Serinc3_13
tgcaagacacaatagtgcca

SEQ ID NO: 52795 - DNA, 20 bp, Artificial Sequence
  sgRNA
  Serinc3_14
gcgcagcaaagacgatggag

SEQ ID NO: 52796 - DNA, 20 bp, Artificial Sequence
  sgRNA
  Serinc3_15
ggtcatcatgatgtacaagg

SEQ ID NO: 52797 - DNA, 20 bp, Artificial Sequence
  sgRNA
  Serinc3_16
gtgtgtgatgatgctcataa

SEQ ID NO: 52798 - DNA, 20 bp, Artificial Sequence
  sgRNA
  Serinc3_17
gtaagaattccactgtaact

SEQ ID NO: 52799 - DNA, 20 bp, Artificial Sequence
  sgRNA
  Serinc3_18
aaagattgtgacgtgctggt

SEQ ID NO: 52800 - DNA, 20 bp, Artificial Sequence
  sgRNA
  Serinc3_19
ggggagccacaagagtccag

SEQ ID NO: 52801 - DNA, 20 bp, Artificial Sequence
  sgRNA
  Serinc3_20
tttcttcattatcatccagc

SEQ ID NO: 52802 - DNA, 20 bp, Artificial Sequence
  sgRNA
  Serinc4_1
catgctgtagaaccctagtg

SEQ ID NO: 52803 - DNA, 20 bp, Artificial Sequence
  sgRNA
  Serinc4_2
ccgtcccccagagacaagtg

SEQ ID NO: 52804 - DNA, 20 bp, Artificial Sequence
  sgRNA
  Serinc4_3
atagcatatacccactgcgg

SEQ ID NO: 52805 - DNA, 20 bp, Artificial Sequence
  sgRNA
  Serinc4_4
ccactgtcttcgaaagcagg

SEQ ID NO: 52806 - DNA, 20 bp, Artificial Sequence
  sgRNA
  Serinc4_5
tgttatgcagctgtgcccga

SEQ ID NO: 52807 - DNA, 20 bp, Artificial Sequence
  sgRNA
  Serinc4_6
tcatggttacccttaccaac

SEQ ID NO: 52808 - DNA, 20 bp, Artificial Sequence
  sgRNA
  Serinc4_7
gtgcaaaagttgtcaccggc

SEQ ID NO: 52809 - DNA, 20 bp, Artificial Sequence
  sgRNA
  Serinc4_8
taaaccttgataatccacaa

SEQ ID NO: 52810 - DNA, 20 bp, Artificial Sequence
  sgRNA
  Serinc4_9
tgttgagcaggcaaccgtca

SEQ ID NO: 52811 - DNA, 20 bp, Artificial Sequence
  sgRNA
  Serinc4_10
acagatgccaatataatgcc

SEQ ID NO: 52812 - DNA, 20 bp, Artificial Sequence
  sgRNA
  Serinc4_11
gtaaaccttgataatccaca

SEQ ID NO: 52813 - DNA, 20 bp, Artificial Sequence
  sgRNA
  Serinc4_12
gctctacatcctcctccacg

SEQ ID NO: 52814 - DNA, 20 bp, Artificial Sequence
  sgRNA
  Serinc4_13
gggcagcagaaacagactga

SEQ ID NO: 52815 - DNA, 20 bp, Artificial Sequence
  sgRNA
  Serinc4_14
ggtcttgcacagcagcacgg

SEQ ID NO: 52816 - DNA, 20 bp, Artificial Sequence
  sgRNA
  Serinc4_15
caccagtacacacaccctga

SEQ ID NO: 52817 - DNA, 20 bp, Artificial Sequence
  sgRNA
  Serinc4_16
tctgcacctgagcagctgga

SEQ ID NO: 52818 - DNA, 20 bp, Artificial Sequence
  sgRNA
  Serinc4_17
gtgtggccagtgacacacct

SEQ ID NO: 52819 - DNA, 20 bp, Artificial Sequence
  sgRNA
  Serinc4_18
gtgctgctgtgcaagaccct

SEQ ID NO: 52820 - DNA, 20 bp, Artificial Sequence
  sgRNA
  Serinc4_19
agattgctgaggctcccacg

SEQ ID NO: 52821 - DNA, 20 bp, Artificial Sequence
  sgRNA
  Serinc4_20
tgatgatagaggcttgtagg

SEQ ID NO: 52822 - DNA, 20 bp, Artificial Sequence
  sgRNA
  Serinc5_1
ccagagagattagcacgcat

SEQ ID NO: 52823 - DNA, 20 bp, Artificial Sequence
  sgRNA
  Serinc5_2
gcaccgtccgtaataagctg

SEQ ID NO: 52824 - DNA, 20 bp, Artificial Sequence
  sgRNA
  Serinc5_3
tgccgggcctacattcacaa

SEQ ID NO: 52825 - DNA, 20 bp, Artificial Sequence
  sgRNA
  Serinc5_4
acaccgcagaataccctacc

SEQ ID NO: 52826 - DNA, 20 bp, Artificial Sequence
  sgRNA
  Serinc5_5
gtaccacagcttattacgga

SEQ ID NO: 52827 - DNA, 20 bp, Artificial Sequence
  sgRNA
  Serinc5_6
gatgctctgcagagtcgata

SEQ ID NO: 52828 - DNA, 20 bp, Artificial Sequence
  sgRNA
  Serinc5_7
gaacctggtagggtattctg

SEQ ID NO: 52829 - DNA, 20 bp, Artificial Sequence
  sgRNA
  Serinc5_8
ttcacctgcttcatcacaga

SEQ ID NO: 52830 - DNA, 20 bp, Artificial Sequence
  sgRNA
  Serinc5_9
tgtcatcatcacacagcaga

SEQ ID NO: 52831 - DNA, 20 bp, Artificial Sequence
  sgRNA
  Serinc5_10
tcagagtcatcatcacgtag

SEQ ID NO: 52832 - DNA, 20 bp, Artificial Sequence
  sgRNA
  Serinc5_11
agagcagcagaacgtcaaga

SEQ ID NO: 52833 - DNA, 20 bp, Artificial Sequence
  sgRNA
  Serinc5_12
gtgcaaactgcacaatcagg

SEQ ID NO: 52834 - DNA, 20 bp, Artificial Sequence
  sgRNA
  Serinc5_13
tcatcacgtagagggaagcc

SEQ ID NO: 52835 - DNA, 20 bp, Artificial Sequence
  sgRNA
  Serinc5_14
gaacgtcaagaagggaccca

SEQ ID NO: 52836 - DNA, 20 bp, Artificial Sequence
  sgRNA
  Serinc5_15
gagcagcagaacgtcaagaa

SEQ ID NO: 52837 - DNA, 20 bp, Artificial Sequence
  sgRNA
  Serinc5_16
agccaagcctccaacagcaa

SEQ ID NO: 52838 - DNA, 20 bp, Artificial Sequence
  sgRNA
  Serinc5_17
ataccctaccaggttctcac

SEQ ID NO: 52839 - DNA, 20 bp, Artificial Sequence
  sgRNA
  Serinc5_18
gttctcacaggcgtcaccac

SEQ ID NO: 52840 - DNA, 20 bp, Artificial Sequence
  sgRNA
  Serinc5_19
cttcacctgcttcatcacag

SEQ ID NO: 52841 - DNA, 20 bp, Artificial Sequence
  sgRNA
  Serinc5_20
ttacagaactcttcaaaaaa

SEQ ID NO: 52842 - DNA, 20 bp, Artificial Sequence
  sgRNA
  Sez6_1
gagtcggactggtaaagacg

SEQ ID NO: 52843 - DNA, 20 bp, Artificial Sequence
  sgRNA
  Sez6_2
ccgcaatggaaataacgtgg

SEQ ID NO: 52844 - DNA, 20 bp, Artificial Sequence
  sgRNA
  Sez6_3
aggaacgactggttagccaa

SEQ ID NO: 52845 - DNA, 20 bp, Artificial Sequence
  sgRNA
  Sez6_4
ctaccctgtgggtacaactg

SEQ ID NO: 52846 - DNA, 20 bp, Artificial Sequence
  sgRNA
  Sez6_5
gctgcgggcaccattctccg

SEQ ID NO: 52847 - DNA, 20 bp, Artificial Sequence
  sgRNA
  Sez6_6
tgatctctactccatatcca

SEQ ID NO: 52848 - DNA, 20 bp, Artificial Sequence
  sgRNA
  Sez6_7
ttgctggtaacccagcgccg

SEQ ID NO: 52849 - DNA, 20 bp, Artificial Sequence
  sgRNA
  Sez6_8
tcgcccctataaccgcatca

SEQ ID NO: 52850 - DNA, 20 bp, Artificial Sequence
  sgRNA
  Sez6_9
tctggacatgtgtcgttgcg

SEQ ID NO: 52851 - DNA, 20 bp, Artificial Sequence
  sgRNA
  Sez6_10
gagctacccgagatccccaa

SEQ ID NO: 52852 - DNA, 20 bp, Artificial Sequence
  sgRNA
  Sez6_11
gcatggactccaactcagga

SEQ ID NO: 52853 - DNA, 20 bp, Artificial Sequence
  sgRNA
  Sez6_12
ataggagtcgtacaccggcg

SEQ ID NO: 52854 - DNA, 20 bp, Artificial Sequence
  sgRNA
  Sez6_13
gcccttcagcacataaccag

SEQ ID NO: 52855 - DNA, 20 bp, Artificial Sequence
  sgRNA
  Sez6_14
tattgcacagttgctcccac

SEQ ID NO: 52856 - DNA, 20 bp, Artificial Sequence
  sgRNA
  Sez6_15
tcataggagtcgtacaccgg

SEQ ID NO: 52857 - DNA, 20 bp, Artificial Sequence
  sgRNA
  Sez6_16
catccgcaatggaaataacg

SEQ ID NO: 52858 - DNA, 20 bp, Artificial Sequence
  sgRNA
  Sez6_17
taccagtccgactccagccg

SEQ ID NO: 52859 - DNA, 20 bp, Artificial Sequence
  sgRNA
  Sez6_18
gcaacaacctcacctgccac

SEQ ID NO: 52860 - DNA, 20 bp, Artificial Sequence
  sgRNA
  Sez6_19
tggtgggtcactccaatgcg

SEQ ID NO: 52861 - DNA, 20 bp, Artificial Sequence
  sgRNA
  Sez6_20
aagttgccgtatttgacaaa

SEQ ID NO: 52862 - DNA, 20 bp, Artificial Sequence
  sgRNA
  Sez6l2_1
tatgctaacactgttcgacg

SEQ ID NO: 52863 - DNA, 20 bp, Artificial Sequence
  sgRNA
  Sez6l2_2
ggatacaatgcgacccagtg

SEQ ID NO: 52864 - DNA, 20 bp, Artificial Sequence
  sgRNA
  Sez6l2_3
gtcagagtcgtaaatcacag

SEQ ID NO: 52865 - DNA, 20 bp, Artificial Sequence
  sgRNA
  Sez6l2_4
ccacacattcgatagcattg

SEQ ID NO: 52866 - DNA, 20 bp, Artificial Sequence
  sgRNA
  Sez6l2_5
gaatctcaatgccataacca

SEQ ID NO: 52867 - DNA, 20 bp, Artificial Sequence
  sgRNA
  Sez6l2_6
ggtgcaatctaggagctcca

SEQ ID NO: 52868 - DNA, 20 bp, Artificial Sequence
  sgRNA
  Sez6l2_7
ccaaatccgggcctaggcca

SEQ ID NO: 52869 - DNA, 20 bp, Artificial Sequence
  sgRNA
  Sez6l2_8
ctacgcttcttctgctacga

SEQ ID NO: 52870 - DNA, 20 bp, Artificial Sequence
  sgRNA
  Sez6l2_9
aggacaatgaccaagcccag

SEQ ID NO: 52871 - DNA, 20 bp, Artificial Sequence
  sgRNA
  Sez6l2_10
gatatgctaacactgttcga

SEQ ID NO: 52872 - DNA, 20 bp, Artificial Sequence
  sgRNA
  Sez6l2_11
gactcaggataccagctaca

SEQ ID NO: 52873 - DNA, 20 bp, Artificial Sequence
  sgRNA
  Sez6l2_12
gtacaagcatcactaccaag

SEQ ID NO: 52874 - DNA, 20 bp, Artificial Sequence
  sgRNA
  Sez6l2_13
ctaacactgttcgacgggga

SEQ ID NO: 52875 - DNA, 20 bp, Artificial Sequence
  sgRNA
  Sez6l2_14
gctcctggacaaccgaaaac

SEQ ID NO: 52876 - DNA, 20 bp, Artificial Sequence
  sgRNA
  Sez6l2_15
gtgacagacttgcatcctgg

SEQ ID NO: 52877 - DNA, 20 bp, Artificial Sequence
  sgRNA
  Sez6l2_16
gctggaggacagcatcccac

SEQ ID NO: 52878 - DNA, 20 bp, Artificial Sequence
  sgRNA
  Sez6l2_17
tgaaatgtaacacgaaaccc

SEQ ID NO: 52879 - DNA, 20 bp, Artificial Sequence
  sgRNA
  Sez6l2_18
gcccaacctcacctgccgct

SEQ ID NO: 52880 - DNA, 20 bp, Artificial Sequence
  sgRNA
  Sez6l2_19
gataggtgagcactgtaccc

SEQ ID NO: 52881 - DNA, 20 bp, Artificial Sequence
  sgRNA
  Sez6l2_20
gcgagatcaccaatggccat

SEQ ID NO: 52882 - DNA, 20 bp, Artificial Sequence
  sgRNA
  Sgca_1
acacattgcaccagtcaacg

SEQ ID NO: 52883 - DNA, 20 bp, Artificial Sequence
  sgRNA
  Sgca_2
tccagggtatacattaaggt

SEQ ID NO: 52884 - DNA, 20 bp, Artificial Sequence
  sgRNA
  Sgca_3
tggaataggaggtaccttcg

SEQ ID NO: 52885 - DNA, 20 bp, Artificial Sequence
  sgRNA
  Sgca_4
taggtgagtcggacagtggg

SEQ ID NO: 52886 - DNA, 20 bp, Artificial Sequence
  sgRNA
  Sgca_5
cctgtacgaacattaaacat

SEQ ID NO: 52887 - DNA, 20 bp, Artificial Sequence
  sgRNA
  Sgca_6
tgtgcgctgtctactcgggg

SEQ ID NO: 52888 - DNA, 20 bp, Artificial Sequence
  sgRNA
  Sgca_7
gcagatggcagccagccgag

SEQ ID NO: 52889 - DNA, 20 bp, Artificial Sequence
  sgRNA
  Sgca_8
tcttcctattgagggacgga

SEQ ID NO: 52890 - DNA, 20 bp, Artificial Sequence
  sgRNA
  Sgca_9
tataaccctggcttcctcta

SEQ ID NO: 52891 - DNA, 20 bp, Artificial Sequence
  sgRNA
  Sgca_10
gatgtccctggaggtgagcg

SEQ ID NO: 52892 - DNA, 20 bp, Artificial Sequence
  sgRNA
  Sgca_11
acaactttacacctacttgt

SEQ ID NO: 52893 - DNA, 20 bp, Artificial Sequence
  sgRNA
  Sgca_12
tcgtgggtaccaagtcatcg

SEQ ID NO: 52894 - DNA, 20 bp, Artificial Sequence
  sgRNA
  Sgca_13
ggagtaggtacctcatccag

SEQ ID NO: 52895 - DNA, 20 bp, Artificial Sequence
  sgRNA
  Sgca_14
ttaatgttcgtacaggagag

SEQ ID NO: 52896 - DNA, 20 bp, Artificial Sequence
  sgRNA
  Sgca_15
tgtgctttcggcgtgaagga

SEQ ID NO: 52897 - DNA, 20 bp, Artificial Sequence
  sgRNA
  Sgca_16
caaacacacgacccacaagt

SEQ ID NO: 52898 - DNA, 20 bp, Artificial Sequence
  sgRNA
  Sgca_17
gcaccagtcaacgcggaagt

SEQ ID NO: 52899 - DNA, 20 bp, Artificial Sequence
  sgRNA
  Sgca_18
tcgtagcaggacagtagtgg

SEQ ID NO: 52900 - DNA, 20 bp, Artificial Sequence
  sgRNA
  Sgca_19
gtacccacgatcttctggag

SEQ ID NO: 52901 - DNA, 20 bp, Artificial Sequence
  sgRNA
  Sgca_20
ccaccaacaaaggcaccaag

SEQ ID NO: 52902 - DNA, 20 bp, Artificial Sequence
  sgRNA
  Sgcb_1
cacacccatttggcccaatg

SEQ ID NO: 52903 - DNA, 20 bp, Artificial Sequence
  sgRNA
  Sgcb_2
aggaccggctccataagact

SEQ ID NO: 52904 - DNA, 20 bp, Artificial Sequence
  sgRNA
  Sgcb_3
ccgtgctcttataaagcggg

SEQ ID NO: 52905 - DNA, 20 bp, Artificial Sequence
  sgRNA
  Sgcb_4
tgacggccaggataaacagg

SEQ ID NO: 52906 - DNA, 20 bp, Artificial Sequence
  sgRNA
  Sgcb_5
cccgctttataagagcacgg

SEQ ID NO: 52907 - DNA, 20 bp, Artificial Sequence
  sgRNA
  Sgcb_6
gcaattgtgcgaggcaacga

SEQ ID NO: 52908 - DNA, 20 bp, Artificial Sequence
  sgRNA
  Sgcb_7
atatccccatcgatgaggac

SEQ ID NO: 52909 - DNA, 20 bp, Artificial Sequence
  sgRNA
  Sgcb_8
acttaaacatcaaagtcgat

SEQ ID NO: 52910 - DNA, 20 bp, Artificial Sequence
  sgRNA
  Sgcb_9
tgatccgcattgggccaaat

SEQ ID NO: 52911 - DNA, 20 bp, Artificial Sequence
  sgRNA
  Sgcb_10
gatgggcgtgcaattgtgcg

SEQ ID NO: 52912 - DNA, 20 bp, Artificial Sequence
  sgRNA
  Sgcb_11
ggagccggtcctcatcgatg

SEQ ID NO: 52913 - DNA, 20 bp, Artificial Sequence
  sgRNA
  Sgcb_12
gtgatccgcattgggccaaa

SEQ ID NO: 52914 - DNA, 20 bp, Artificial Sequence
  sgRNA
  Sgcb_13
ccaccgtgctcttataaagc

SEQ ID NO: 52915 - DNA, 20 bp, Artificial Sequence
  sgRNA
  Sgcb_14
gaaaacagcatcatcctcaa

SEQ ID NO: 52916 - DNA, 20 bp, Artificial Sequence
  sgRNA
  Sgcb_15
agcatggagttccacgagag

SEQ ID NO: 52917 - DNA, 20 bp, Artificial Sequence
  sgRNA
  Sgcb_16
cctgcccagttcctccagcg

SEQ ID NO: 52918 - DNA, 20 bp, Artificial Sequence
  sgRNA
  Sgcb_17
acacaatatcctgttcagca

SEQ ID NO: 52919 - DNA, 20 bp, Artificial Sequence
  sgRNA
  Sgcb_18
cctccatcaccagcgacatc

SEQ ID NO: 52920 - DNA, 20 bp, Artificial Sequence
  sgRNA
  Sgcb_19
actccctgactggtccccgc

SEQ ID NO: 52921 - DNA, 20 bp, Artificial Sequence
  sgRNA
  Sgcb_20
ccacccgctttataagagca

SEQ ID NO: 52922 - DNA, 20 bp, Artificial Sequence
  sgRNA
  Sgcd_1
atccccactttgtatatgtg

SEQ ID NO: 52923 - DNA, 20 bp, Artificial Sequence
  sgRNA
  Sgcd_2
gagattgagagtcttaggtg

SEQ ID NO: 52924 - DNA, 20 bp, Artificial Sequence
  sgRNA
  Sgcd_3
catgaccttgagaatccaga

SEQ ID NO: 52925 - DNA, 20 bp, Artificial Sequence
  sgRNA
  Sgcd_4
cttaccttagttccttgaag

SEQ ID NO: 52926 - DNA, 20 bp, Artificial Sequence
  sgRNA
  Sgcd_5
gtgggtgtgtaggatccacg

SEQ ID NO: 52927 - DNA, 20 bp, Artificial Sequence
  sgRNA
  Sgcd_6
gatgacagtgaagtggtcgt

SEQ ID NO: 52928 - DNA, 20 bp, Artificial Sequence
  sgRNA
  Sgcd_7
gggcttccatcactagagat

SEQ ID NO: 52929 - DNA, 20 bp, Artificial Sequence
  sgRNA
  Sgcd_8
gcaccatgcccagctctgag

SEQ ID NO: 52930 - DNA, 20 bp, Artificial Sequence
  sgRNA
  Sgcd_9
tcaccagtattaaaatcatg

SEQ ID NO: 52931 - DNA, 20 bp, Artificial Sequence
  sgRNA
  Sgcd_10
aggtctgcgtctgcgccaat

SEQ ID NO: 52932 - DNA, 20 bp, Artificial Sequence
  sgRNA
  Sgcd_11
tctgcgtctgcgccaatggg

SEQ ID NO: 52933 - DNA, 20 bp, Artificial Sequence
  sgRNA
  Sgcd_12
cctacacacccacaggaacg

SEQ ID NO: 52934 - DNA, 20 bp, Artificial Sequence
  sgRNA
  Sgcd_13
ccctatacttcaaatctgcc

SEQ ID NO: 52935 - DNA, 20 bp, Artificial Sequence
  sgRNA
  Sgcd_14
ctagtgatggaagccccaaa

SEQ ID NO: 52936 - DNA, 20 bp, Artificial Sequence
  sgRNA
  Sgcd_15
aaactacctagactgcctcg

SEQ ID NO: 52937 - DNA, 20 bp, Artificial Sequence
  sgRNA
  Sgcd_16
ggggccacacatatacaaag

SEQ ID NO: 52938 - DNA, 20 bp, Artificial Sequence
  sgRNA
  Sgcd_17
accttctgcctcgttcctgt

SEQ ID NO: 52939 - DNA, 20 bp, Artificial Sequence
  sgRNA
  Sgcd_18
ggacaggaataacctcccat

SEQ ID NO: 52940 - DNA, 20 bp, Artificial Sequence
  sgRNA
  Sgcd_19
cagaccccttcaaggaacta

SEQ ID NO: 52941 - DNA, 20 bp, Artificial Sequence
  sgRNA
  Sgcd_20
cgtggatcctacacacccac

SEQ ID NO: 52942 - DNA, 20 bp, Artificial Sequence
  sgRNA
  Sgce_1
gatggcttcgatatatccaa

SEQ ID NO: 52943 - DNA, 20 bp, Artificial Sequence
  sgRNA
  Sgce_2
agaatgtgccagtggtcgcg

SEQ ID NO: 52944 - DNA, 20 bp, Artificial Sequence
  sgRNA
  Sgce_3
cgactggtgcaagatttcac

SEQ ID NO: 52945 - DNA, 20 bp, Artificial Sequence
  sgRNA
  Sgce_4
gcttcctattaatgacatga

SEQ ID NO: 52946 - DNA, 20 bp, Artificial Sequence
  sgRNA
  Sgce_5
ttatatcatgtgctgccgac

SEQ ID NO: 52947 - DNA, 20 bp, Artificial Sequence
  sgRNA
  Sgce_6
gaaaagccgagactattaca

SEQ ID NO: 52948 - DNA, 20 bp, Artificial Sequence
  sgRNA
  Sgce_7
tcggtgtgagaacctctgaa

SEQ ID NO: 52949 - DNA, 20 bp, Artificial Sequence
  sgRNA
  Sgce_8
ggacatgtctcgaagctcct

SEQ ID NO: 52950 - DNA, 20 bp, Artificial Sequence
  sgRNA
  Sgce_9
gttccaccctgtaactggag

SEQ ID NO: 52951 - DNA, 20 bp, Artificial Sequence
  sgRNA
  Sgce_10
caggactccatcactgtacg

SEQ ID NO: 52952 - DNA, 20 bp, Artificial Sequence
  sgRNA
  Sgce_11
caggaagtagttcgtggcga

SEQ ID NO: 52953 - DNA, 20 bp, Artificial Sequence
  sgRNA
  Sgce_12
cctttcccgtccaagcacaa

SEQ ID NO: 52954 - DNA, 20 bp, Artificial Sequence
  sgRNA
  Sgce_13
gctacccagatagacctgga

SEQ ID NO: 52955 - DNA, 20 bp, Artificial Sequence
  sgRNA
  Sgce_14
tcggggctgtaaaaaatgtg

SEQ ID NO: 52956 - DNA, 20 bp, Artificial Sequence
  sgRNA
  Sgce_15
gttaagatgcagtcaagaaa

SEQ ID NO: 52957 - DNA, 20 bp, Artificial Sequence
  sgRNA
  Sgce_16
ctcgattcagaaatctacca

SEQ ID NO: 52958 - DNA, 20 bp, Artificial Sequence
  sgRNA
  Sgce_17
acgtcagccctggatagggg

SEQ ID NO: 52959 - DNA, 20 bp, Artificial Sequence
  sgRNA
  Sgce_18
gaactcactttcatatcgac

SEQ ID NO: 52960 - DNA, 20 bp, Artificial Sequence
  sgRNA
  Sgce_19
cactctgccacccctatcca

SEQ ID NO: 52961 - DNA, 20 bp, Artificial Sequence
  sgRNA
  Sgce_20
gttatgccttgcagtctcaa

SEQ ID NO: 52962 - DNA, 20 bp, Artificial Sequence
  sgRNA
  Sgcz_1
aaacgcacaactctaccctg

SEQ ID NO: 52963 - DNA, 20 bp, Artificial Sequence
  sgRNA
  Sgcz_2
tgaagatgagatcactattg

SEQ ID NO: 52964 - DNA, 20 bp, Artificial Sequence
  sgRNA
  Sgcz_3
tgaatgcaaggaaccatatg

SEQ ID NO: 52965 - DNA, 20 bp, Artificial Sequence
  sgRNA
  Sgcz_4
gaaggttatgaatttcactg

SEQ ID NO: 52966 - DNA, 20 bp, Artificial Sequence
  sgRNA
  Sgcz_5
gccatccataaatccccaca

SEQ ID NO: 52967 - DNA, 20 bp, Artificial Sequence
  sgRNA
  Sgcz_6
gctactactggactgacagg

SEQ ID NO: 52968 - DNA, 20 bp, Artificial Sequence
  sgRNA
  Sgcz_7
gaagaagagaaggaaccgat

SEQ ID NO: 52969 - DNA, 20 bp, Artificial Sequence
  sgRNA
  Sgcz_8
agaaaggtagagtttgccat

SEQ ID NO: 52970 - DNA, 20 bp, Artificial Sequence
  sgRNA
  Sgcz_9
cggctgggaaatctaccaat

SEQ ID NO: 52971 - DNA, 20 bp, Artificial Sequence
  sgRNA
  Sgcz_10
aaatgcagattcaatccggc

SEQ ID NO: 52972 - DNA, 20 bp, Artificial Sequence
  sgRNA
  Sgcz_11
actcagatataccttcaagt

SEQ ID NO: 52973 - DNA, 20 bp, Artificial Sequence
  sgRNA
  Sgcz_12
gtgacttcaaggctacctgc

SEQ ID NO: 52974 - DNA, 20 bp, Artificial Sequence
  sgRNA
  Sgcz_13
cttcaaggctacctgcagga

SEQ ID NO: 52975 - DNA, 20 bp, Artificial Sequence
  sgRNA
  Sgcz_14
gcacttacagtccacagaag

SEQ ID NO: 52976 - DNA, 20 bp, Artificial Sequence
  sgRNA
  Sgcz_15
aatctgagagtcaccaagaa

SEQ ID NO: 52977 - DNA, 20 bp, Artificial Sequence
  sgRNA
  Sgcz_16
ctcactggacagctgacagt

SEQ ID NO: 52978 - DNA, 20 bp, Artificial Sequence
  sgRNA
  Sgcz_17
gaaagaaattcattcccgaa

SEQ ID NO: 52979 - DNA, 20 bp, Artificial Sequence
  sgRNA
  Sgcz_18
gatggctctgctctgatgtg

SEQ ID NO: 52980 - DNA, 20 bp, Artificial Sequence
  sgRNA
  Sgcz_19
actctacctttctccagctg

SEQ ID NO: 52981 - DNA, 20 bp, Artificial Sequence
  sgRNA
  Sgcz_20
ccagtagtagcatttgcttg

SEQ ID NO: 52982 - DNA, 20 bp, Artificial Sequence
  sgRNA
  Shisa4_1
cctgttgttacctataccga

SEQ ID NO: 52983 - DNA, 20 bp, Artificial Sequence
  sgRNA
  Shisa4_2
tggcgagtgaggactgcttg

SEQ ID NO: 52984 - DNA, 20 bp, Artificial Sequence
  sgRNA
  Shisa4_3
gagacagcagaaacactgcc

SEQ ID NO: 52985 - DNA, 20 bp, Artificial Sequence
  sgRNA
  Shisa4_4
aacaaagaggattacagcag

SEQ ID NO: 52986 - DNA, 20 bp, Artificial Sequence
  sgRNA
  Shisa4_5
gccagtataccagtaccccc

SEQ ID NO: 52987 - DNA, 20 bp, Artificial Sequence
  sgRNA
  Shisa4_6
ggtttcatgtacccacctag

SEQ ID NO: 52988 - DNA, 20 bp, Artificial Sequence
  sgRNA
  Shisa4_7
ccttcggtataggtaacaac

SEQ ID NO: 52989 - DNA, 20 bp, Artificial Sequence
  sgRNA
  Shisa4_8
tgtggtggcatataaggcgg

SEQ ID NO: 52990 - DNA, 20 bp, Artificial Sequence
  sgRNA
  Shisa4_9
tggcaaccacagcaacaaag

SEQ ID NO: 52991 - DNA, 20 bp, Artificial Sequence
  sgRNA
  Shisa4_10
agcaggacgacggctgcgag

SEQ ID NO: 52992 - DNA, 20 bp, Artificial Sequence
  sgRNA
  Shisa4_11
ctaccagcggtactgctgca

SEQ ID NO: 52993 - DNA, 20 bp, Artificial Sequence
  sgRNA
  Shisa4_12
cccaagcaccagcaggacga

SEQ ID NO: 52994 - DNA, 20 bp, Artificial Sequence
  sgRNA
  Shisa4_13
gctgcgggacctgctaccag

SEQ ID NO: 52995 - DNA, 20 bp, Artificial Sequence
  sgRNA
  Shisa4_14
gggtacatgaaaccaggctg

SEQ ID NO: 52996 - DNA, 20 bp, Artificial Sequence
  sgRNA
  Shisa4_15
ggccagctttgggatccggg

SEQ ID NO: 52997 - DNA, 20 bp, Artificial Sequence
  sgRNA
  Shisa4_16
actgcttgtggtatctggac

SEQ ID NO: 52998 - DNA, 20 bp, Artificial Sequence
  sgRNA
  Shisa4_17
ggtccctgcagcagtaccgc

SEQ ID NO: 52999 - DNA, 20 bp, Artificial Sequence
  sgRNA
  Shisa4_18
gaggagccccaagcaccagc

SEQ ID NO: 53000 - DNA, 20 bp, Artificial Sequence
  sgRNA
  Shisa4_19
gcagtcaaatcccggatgcc

SEQ ID NO: 53001 - DNA, 20 bp, Artificial Sequence
  sgRNA
  Shisa4_20
ataggtaacaacaggaacag

SEQ ID NO: 53002 - DNA, 20 bp, Artificial Sequence
  sgRNA
  Shisa6_1
tggggctactacgacgtgag

SEQ ID NO: 53003 - DNA, 20 bp, Artificial Sequence
  sgRNA
  Shisa6_2
caccgtctacatcacttgcg

SEQ ID NO: 53004 - DNA, 20 bp, Artificial Sequence
  sgRNA
  Shisa6_3
gggaaccggaccctgaacgc

SEQ ID NO: 53005 - DNA, 20 bp, Artificial Sequence
  sgRNA
  Shisa6_4
caactaccaaagccccgtat

SEQ ID NO: 53006 - DNA, 20 bp, Artificial Sequence
  sgRNA
  Shisa6_5
ggatgttcatctctcgcgga

SEQ ID NO: 53007 - DNA, 20 bp, Artificial Sequence
  sgRNA
  Shisa6_6
cgggaaccggaccctgaacg

SEQ ID NO: 53008 - DNA, 20 bp, Artificial Sequence
  sgRNA
  Shisa6_7
taacattctgacgtcggcca

SEQ ID NO: 53009 - DNA, 20 bp, Artificial Sequence
  sgRNA
  Shisa6_8
gcaccaaggtagtgtcgccg

SEQ ID NO: 53010 - DNA, 20 bp, Artificial Sequence
  sgRNA
  Shisa6_9
ttaggaagaggacacacgaa

SEQ ID NO: 53011 - DNA, 20 bp, Artificial Sequence
  sgRNA
  Shisa6_10
gttacttacgagacgtgctg

SEQ ID NO: 53012 - DNA, 20 bp, Artificial Sequence
  sgRNA
  Shisa6_11
tggatgttcatctctcgcgg

SEQ ID NO: 53013 - DNA, 20 bp, Artificial Sequence
  sgRNA
  Shisa6_12
tgggtagcgctgcttaagat

SEQ ID NO: 53014 - DNA, 20 bp, Artificial Sequence
  sgRNA
  Shisa6_13
tcagacaagatgcggtcata

SEQ ID NO: 53015 - DNA, 20 bp, Artificial Sequence
  sgRNA
  Shisa6_14
gtagcggtccagcactggcg

SEQ ID NO: 53016 - DNA, 20 bp, Artificial Sequence
  sgRNA
  Shisa6_15
gtctgcgagaggcaaaggcg

SEQ ID NO: 53017 - DNA, 20 bp, Artificial Sequence
  sgRNA
  Shisa6_16
tcaccgtctacatcacttgc

SEQ ID NO: 53018 - DNA, 20 bp, Artificial Sequence
  sgRNA
  Shisa6_17
ggagatctggtcctccactt

SEQ ID NO: 53019 - DNA, 20 bp, Artificial Sequence
  sgRNA
  Shisa6_18
gtcagaatgttattcatccg

SEQ ID NO: 53020 - DNA, 20 bp, Artificial Sequence
  sgRNA
  Shisa6_19
gcccgagaacaagtacgacc

SEQ ID NO: 53021 - DNA, 20 bp, Artificial Sequence
  sgRNA
  Shisa6_20
tgcctctcgcagacacaaca

SEQ ID NO: 53022 - DNA, 20 bp, Artificial Sequence
  sgRNA
  Shisa7_1
tgcaagggcagcgttccgcg

SEQ ID NO: 53023 - DNA, 20 bp, Artificial Sequence
  sgRNA
  Shisa7_2
gatgactccgcacaccacgt

SEQ ID NO: 53024 - DNA, 20 bp, Artificial Sequence
  sgRNA
  Shisa7_3
ggtgccacaacagaagcggt

SEQ ID NO: 53025 - DNA, 20 bp, Artificial Sequence
  sgRNA
  Shisa7_4
accaagaccagccccgcgag

SEQ ID NO: 53026 - DNA, 20 bp, Artificial Sequence
  sgRNA
  Shisa7_5
agacaactggagatgccgcg

SEQ ID NO: 53027 - DNA, 20 bp, Artificial Sequence
  sgRNA
  Shisa7_6
tgcggaggctagcagcgcga

SEQ ID NO: 53028 - DNA, 20 bp, Artificial Sequence
  sgRNA
  Shisa7_7
tcctgggacataacacgccg

SEQ ID NO: 53029 - DNA, 20 bp, Artificial Sequence
  sgRNA
  Shisa7_8
aggcaacgtgaactcatagc

SEQ ID NO: 53030 - DNA, 20 bp, Artificial Sequence
  sgRNA
  Shisa7_9
cctgggacataacacgccgt

SEQ ID NO: 53031 - DNA, 20 bp, Artificial Sequence
  sgRNA
  Shisa7_10
acagcagcctcataggacgg

SEQ ID NO: 53032 - DNA, 20 bp, Artificial Sequence
  sgRNA
  Shisa7_11
tggcaccagcacccaaccca

SEQ ID NO: 53033 - DNA, 20 bp, Artificial Sequence
  sgRNA
  Shisa7_12
agtcatcagtttcgccctgg

SEQ ID NO: 53034 - DNA, 20 bp, Artificial Sequence
  sgRNA
  Shisa7_13
gaggcaacgtgaactcatag

SEQ ID NO: 53035 - DNA, 20 bp, Artificial Sequence
  sgRNA
  Shisa7_14
agcaggacctgcaacccgcc

SEQ ID NO: 53036 - DNA, 20 bp, Artificial Sequence
  sgRNA
  Shisa7_15
ggatagtgtggagtagtgca

SEQ ID NO: 53037 - DNA, 20 bp, Artificial Sequence
  sgRNA
  Shisa7_16
gcaaggcgtcacgtgcaccc

SEQ ID NO: 53038 - DNA, 20 bp, Artificial Sequence
  sgRNA
  Shisa7_17
tgcccttgcatgcactccgg

SEQ ID NO: 53039 - DNA, 20 bp, Artificial Sequence
  sgRNA
  Shisa7_18
tggtgggcatgcaggcctga

SEQ ID NO: 53040 - DNA, 20 bp, Artificial Sequence
  sgRNA
  Shisa7_19
ggaggtggctaccgtatgga

SEQ ID NO: 53041 - DNA, 20 bp, Artificial Sequence
  sgRNA
  Shisa7_20
gcagcagaaacggtagtggc

SEQ ID NO: 53042 - DNA, 20 bp, Artificial Sequence
  sgRNA
  Shisa8_1
acaccgcgtagaccgcagtg

SEQ ID NO: 53043 - DNA, 20 bp, Artificial Sequence
  sgRNA
  Shisa8_2
gcctcaataatgcgcctctg

SEQ ID NO: 53044 - DNA, 20 bp, Artificial Sequence
  sgRNA
  Shisa8_3
ctgctccaactacgacacac

SEQ ID NO: 53045 - DNA, 20 bp, Artificial Sequence
  sgRNA
  Shisa8_4
tggacgcagttacccaaggg

SEQ ID NO: 53046 - DNA, 20 bp, Artificial Sequence
  sgRNA
  Shisa8_5
ccatcacgtcgtaatagccg

SEQ ID NO: 53047 - DNA, 20 bp, Artificial Sequence
  sgRNA
  Shisa8_6
gccacggcgccagttcagcg

SEQ ID NO: 53048 - DNA, 20 bp, Artificial Sequence
  sgRNA
  Shisa8_7
cagccacactgcggtctacg

SEQ ID NO: 53049 - DNA, 20 bp, Artificial Sequence
  sgRNA
  Shisa8_8
gccggaggtacgtaacccgg

SEQ ID NO: 53050 - DNA, 20 bp, Artificial Sequence
  sgRNA
  Shisa8_9
acctggacgcagttacccaa

SEQ ID NO: 53051 - DNA, 20 bp, Artificial Sequence
  sgRNA
  Shisa8_10
ccggaggtacgtaacccgga

SEQ ID NO: 53052 - DNA, 20 bp, Artificial Sequence
  sgRNA
  Shisa8_11
ccgggttacgtacctccggc

SEQ ID NO: 53053 - DNA, 20 bp, Artificial Sequence
  sgRNA
  Shisa8_12
ccgaggagcaggagatcgca

SEQ ID NO: 53054 - DNA, 20 bp, Artificial Sequence
  sgRNA
  Shisa8_13
cgtcgtaatagccgcggcag

SEQ ID NO: 53055 - DNA, 20 bp, Artificial Sequence
  sgRNA
  Shisa8_14
gccgctctactcgtgctggt

SEQ ID NO: 53056 - DNA, 20 bp, Artificial Sequence
  sgRNA
  Shisa8_15
ttacgacgtgatgggccagt

SEQ ID NO: 53057 - DNA, 20 bp, Artificial Sequence
  sgRNA
  Shisa8_16
cgtcggtcccttatgccgcc

SEQ ID NO: 53058 - DNA, 20 bp, Artificial Sequence
  sgRNA
  Shisa8_17
gctcccccgtagccacttgg

SEQ ID NO: 53059 - DNA, 20 bp, Artificial Sequence
  sgRNA
  Shisa8_18
actcgtgctggtcggcatcg

SEQ ID NO: 53060 - DNA, 20 bp, Artificial Sequence
  sgRNA
  Shisa8_19
cctggcagaagcccacacag

SEQ ID NO: 53061 - DNA, 20 bp, Artificial Sequence
  sgRNA
  Shisa8_20
gagcaccaacagcaaagccg

SEQ ID NO: 53062 - DNA, 20 bp, Artificial Sequence
  sgRNA
  Shisa9_1
ggagagagaccttaacatcg

SEQ ID NO: 53063 - DNA, 20 bp, Artificial Sequence
  sgRNA
  Shisa9_2
ttgcccgtgttaagccagag

SEQ ID NO: 53064 - DNA, 20 bp, Artificial Sequence
  sgRNA
  Shisa9_3
cccacgccagactcctgtcg

SEQ ID NO: 53065 - DNA, 20 bp, Artificial Sequence
  sgRNA
  Shisa9_4
ccacattcataccccaacct

SEQ ID NO: 53066 - DNA, 20 bp, Artificial Sequence
  sgRNA
  Shisa9_5
tggcctcatgacatccgcaa

SEQ ID NO: 53067 - DNA, 20 bp, Artificial Sequence
  sgRNA
  Shisa9_6
gatgatgtagacgataaggt

SEQ ID NO: 53068 - DNA, 20 bp, Artificial Sequence
  sgRNA
  Shisa9_7
gctgggtgcgagtccccaag

SEQ ID NO: 53069 - DNA, 20 bp, Artificial Sequence
  sgRNA
  Shisa9_8
gtggcctcatgacatccgca

SEQ ID NO: 53070 - DNA, 20 bp, Artificial Sequence
  sgRNA
  Shisa9_9
cggcaggcttatggcaacaa

SEQ ID NO: 53071 - DNA, 20 bp, Artificial Sequence
  sgRNA
  Shisa9_10
acgccactctggcttaacac

SEQ ID NO: 53072 - DNA, 20 bp, Artificial Sequence
  sgRNA
  Shisa9_11
cccgagctgcagttgaacgg

SEQ ID NO: 53073 - DNA, 20 bp, Artificial Sequence
  sgRNA
  Shisa9_12
tctgctgcacgtttaagaag

SEQ ID NO: 53074 - DNA, 20 bp, Artificial Sequence
  sgRNA
  Shisa9_13
tgttctcataatgctgcacg

SEQ ID NO: 53075 - DNA, 20 bp, Artificial Sequence
  sgRNA
  Shisa9_14
tgttgccataagcctgccgc

SEQ ID NO: 53076 - DNA, 20 bp, Artificial Sequence
  sgRNA
  Shisa9_15
gcggatgtcatgaggccaca

SEQ ID NO: 53077 - DNA, 20 bp, Artificial Sequence
  sgRNA
  Shisa9_16
tgggcatcttcaccaagctg

SEQ ID NO: 53078 - DNA, 20 bp, Artificial Sequence
  sgRNA
  Shisa9_17
gctcatcttccactcttaca

SEQ ID NO: 53079 - DNA, 20 bp, Artificial Sequence
  sgRNA
  Shisa9_18
tcttaaacgtgcagcagaac

SEQ ID NO: 53080 - DNA, 20 bp, Artificial Sequence
  sgRNA
  Shisa9_19
gagcccttgcggatgtcatg

SEQ ID NO: 53081 - DNA, 20 bp, Artificial Sequence
  sgRNA
  Shisa9_20
ttatcgtctacatcatctgc

SEQ ID NO: 53082 - DNA, 20 bp, Artificial Sequence
  sgRNA
  Sidt1_1
tttcgatcgcgtctacagcg

SEQ ID NO: 53083 - DNA, 20 bp, Artificial Sequence
  sgRNA
  Sidt1_2
ttgtgcttgtccatcatgtg

SEQ ID NO: 53084 - DNA, 20 bp, Artificial Sequence
  sgRNA
  Sidt1_3
cccgcggctacagataccaa

SEQ ID NO: 53085 - DNA, 20 bp, Artificial Sequence
  sgRNA
  Sidt1_4
gaacggagacaactgaacac

SEQ ID NO: 53086 - DNA, 20 bp, Artificial Sequence
  sgRNA
  Sidt1_5
agaacaccatagcagcccgc

SEQ ID NO: 53087 - DNA, 20 bp, Artificial Sequence
  sgRNA
  Sidt1_6
tcactgccagcacgcccgaa

SEQ ID NO: 53088 - DNA, 20 bp, Artificial Sequence
  sgRNA
  Sidt1_7
cagctctgcggatttcgcga

SEQ ID NO: 53089 - DNA, 20 bp, Artificial Sequence
  sgRNA
  Sidt1_8
actgttgacatgcacccgca

SEQ ID NO: 53090 - DNA, 20 bp, Artificial Sequence
  sgRNA
  Sidt1_9
gctaccagtcttctgcatcg

SEQ ID NO: 53091 - DNA, 20 bp, Artificial Sequence
  sgRNA
  Sidt1_10
gtagcgtccatggcgcccca

SEQ ID NO: 53092 - DNA, 20 bp, Artificial Sequence
  sgRNA
  Sidt1_11
gggatagcactgatgatgga

SEQ ID NO: 53093 - DNA, 20 bp, Artificial Sequence
  sgRNA
  Sidt1_12
gctctatcagacccgccacc

SEQ ID NO: 53094 - DNA, 20 bp, Artificial Sequence
  sgRNA
  Sidt1_13
gcagctctgcggatttcgcg

SEQ ID NO: 53095 - DNA, 20 bp, Artificial Sequence
  sgRNA
  Sidt1_14
gatttcgatcgcgtctacag

SEQ ID NO: 53096 - DNA, 20 bp, Artificial Sequence
  sgRNA
  Sidt1_15
cgatcgcgtctacagcgggg

SEQ ID NO: 53097 - DNA, 20 bp, Artificial Sequence
  sgRNA
  Sidt1_16
ggtgaccagcaacttgtagt

SEQ ID NO: 53098 - DNA, 20 bp, Artificial Sequence
  sgRNA
  Sidt1_17
ggactccgttatcattaaag

SEQ ID NO: 53099 - DNA, 20 bp, Artificial Sequence
  sgRNA
  Sidt1_18
ctctgcgcagaactatcagc

SEQ ID NO: 53100 - DNA, 20 bp, Artificial Sequence
  sgRNA
  Sidt1_19
cagtgcataaaacacagcga

SEQ ID NO: 53101 - DNA, 20 bp, Artificial Sequence
  sgRNA
  Sidt1_20
aatccagcaggacacactca

SEQ ID NO: 53102 - DNA, 20 bp, Artificial Sequence
  sgRNA
  Sidt2_1
atagttgtaaccctcgtaag

SEQ ID NO: 53103 - DNA, 20 bp, Artificial Sequence
  sgRNA
  Sidt2_2
tcttggaccatagatatcag

SEQ ID NO: 53104 - DNA, 20 bp, Artificial Sequence
  sgRNA
  Sidt2_3
caaaaacgtcattcgaacca

SEQ ID NO: 53105 - DNA, 20 bp, Artificial Sequence
  sgRNA
  Sidt2_4
tgttgtccagatcatagaca

SEQ ID NO: 53106 - DNA, 20 bp, Artificial Sequence
  sgRNA
  Sidt2_5
gaacgtctcgcagaaagacg

SEQ ID NO: 53107 - DNA, 20 bp, Artificial Sequence
  sgRNA
  Sidt2_6
gtttgtggtccgccagaagg

SEQ ID NO: 53108 - DNA, 20 bp, Artificial Sequence
  sgRNA
  Sidt2_7
cctggcagtgccccttacga

SEQ ID NO: 53109 - DNA, 20 bp, Artificial Sequence
  sgRNA
  Sidt2_8
ggatggagatgactgagcag

SEQ ID NO: 53110 - DNA, 20 bp, Artificial Sequence
  sgRNA
  Sidt2_9
ccagctccgagtcaaccgtg

SEQ ID NO: 53111 - DNA, 20 bp, Artificial Sequence
  sgRNA
  Sidt2_10
ggagtttgagcgcacctacg

SEQ ID NO: 53112 - DNA, 20 bp, Artificial Sequence
  sgRNA
  Sidt2_11
gccgcactgcctgagacata

SEQ ID NO: 53113 - DNA, 20 bp, Artificial Sequence
  sgRNA
  Sidt2_12
gagctcatggagtccagtcg

SEQ ID NO: 53114 - DNA, 20 bp, Artificial Sequence
  sgRNA
  Sidt2_13
gacggagaagacaatccaga

SEQ ID NO: 53115 - DNA, 20 bp, Artificial Sequence
  sgRNA
  Sidt2_14
tcatgggcaacattatcaac

SEQ ID NO: 53116 - DNA, 20 bp, Artificial Sequence
  sgRNA
  Sidt2_15
ctttgcctgcaggaattcag

SEQ ID NO: 53117 - DNA, 20 bp, Artificial Sequence
  sgRNA
  Sidt2_16
tgtgctccctggactctgcg

SEQ ID NO: 53118 - DNA, 20 bp, Artificial Sequence
  sgRNA
  Sidt2_17
gtgccagatcagccacacag

SEQ ID NO: 53119 - DNA, 20 bp, Artificial Sequence
  sgRNA
  Sidt2_18
ggatgtaccccaagttgctg

SEQ ID NO: 53120 - DNA, 20 bp, Artificial Sequence
  sgRNA
  Sidt2_19
ctgcatcgtctgcacctccg

SEQ ID NO: 53121 - DNA, 20 bp, Artificial Sequence
  sgRNA
  Sidt2_20
gctgttgacgtcgtccgcgt

SEQ ID NO: 53122 - DNA, 20 bp, Artificial Sequence
  sgRNA
  Sigirr_1
ttggtaccaagacacttacg

SEQ ID NO: 53123 - DNA, 20 bp, Artificial Sequence
  sgRNA
  Sigirr_2
cctcagttggagcggcgtcg

SEQ ID NO: 53124 - DNA, 20 bp, Artificial Sequence
  sgRNA
  Sigirr_3
aagccacttcagcctccatg

SEQ ID NO: 53125 - DNA, 20 bp, Artificial Sequence
  sgRNA
  Sigirr_4
cggaagctctggctacacca

SEQ ID NO: 53126 - DNA, 20 bp, Artificial Sequence
  sgRNA
  Sigirr_5
gcagtcgctataggacacgt

SEQ ID NO: 53127 - DNA, 20 bp, Artificial Sequence
  sgRNA
  Sigirr_6
cgtcctctcacgattagcat

SEQ ID NO: 53128 - DNA, 20 bp, Artificial Sequence
  sgRNA
  Sigirr_7
gatcccatgctaatcgtgag

SEQ ID NO: 53129 - DNA, 20 bp, Artificial Sequence
  sgRNA
  Sigirr_8
agacatccatttcactgccg

SEQ ID NO: 53130 - DNA, 20 bp, Artificial Sequence
  sgRNA
  Sigirr_9
gggatacaaactcttcctag

SEQ ID NO: 53131 - DNA, 20 bp, Artificial Sequence
  sgRNA
  Sigirr_10
gctctcgaaactacagtgca

SEQ ID NO: 53132 - DNA, 20 bp, Artificial Sequence
  sgRNA
  Sigirr_11
gccaggcttccaaagcacca

SEQ ID NO: 53133 - DNA, 20 bp, Artificial Sequence
  sgRNA
  Sigirr_12
gtcctatagcgactgcccag

SEQ ID NO: 53134 - DNA, 20 bp, Artificial Sequence
  sgRNA
  Sigirr_13
gcatacccaggtctccctca

SEQ ID NO: 53135 - DNA, 20 bp, Artificial Sequence
  sgRNA
  Sigirr_14
gtatgctcactgcagatcaa

SEQ ID NO: 53136 - DNA, 20 bp, Artificial Sequence
  sgRNA
  Sigirr_15
ggttccatagtcctctgcat

SEQ ID NO: 53137 - DNA, 20 bp, Artificial Sequence
  sgRNA
  Sigirr_16
ggcctgtactgcaccttccg

SEQ ID NO: 53138 - DNA, 20 bp, Artificial Sequence
  sgRNA
  Sigirr_17
gcagaaccaccaggaccagg

SEQ ID NO: 53139 - DNA, 20 bp, Artificial Sequence
  sgRNA
  Sigirr_18
actcaggttcaccaaaaggt

SEQ ID NO: 53140 - DNA, 20 bp, Artificial Sequence
  sgRNA
  Sigirr_19
tcagtgcagtggctgaaaga

SEQ ID NO: 53141 - DNA, 20 bp, Artificial Sequence
  sgRNA
  Sigirr_20
gcaccagggtcacgaggtgg

SEQ ID NO: 53142 - DNA, 20 bp, Artificial Sequence
  sgRNA
  Siglec1_1
actgagtgtaacatgacgtg

SEQ ID NO: 53143 - DNA, 20 bp, Artificial Sequence
  sgRNA
  Siglec1_2
gcgctccagtccattgagtg

SEQ ID NO: 53144 - DNA, 20 bp, Artificial Sequence
  sgRNA
  Siglec1_3
tgctatcactgatctcaaag

SEQ ID NO: 53145 - DNA, 20 bp, Artificial Sequence
  sgRNA
  Siglec1_4
ctcatactactgtaggacgc

SEQ ID NO: 53146 - DNA, 20 bp, Artificial Sequence
  sgRNA
  Siglec1_5
gtttcaccggaatcgcctcg

SEQ ID NO: 53147 - DNA, 20 bp, Artificial Sequence
  sgRNA
  Siglec1_6
gcactgagtgtaacatgacg

SEQ ID NO: 53148 - DNA, 20 bp, Artificial Sequence
  sgRNA
  Siglec1_7
gctccatcagtaccacccag

SEQ ID NO: 53149 - DNA, 20 bp, Artificial Sequence
  sgRNA
  Siglec1_8
gggcatcctcgactgtcgag

SEQ ID NO: 53150 - DNA, 20 bp, Artificial Sequence
  sgRNA
  Siglec1_9
aagtcaaaatgaaccccgca

SEQ ID NO: 53151 - DNA, 20 bp, Artificial Sequence
  sgRNA
  Siglec1_10
tgcctttgacatctaaccag

SEQ ID NO: 53152 - DNA, 20 bp, Artificial Sequence
  sgRNA
  Siglec1_11
ggcctctaccctacaaggcg

SEQ ID NO: 53153 - DNA, 20 bp, Artificial Sequence
  sgRNA
  Siglec1_12
gtgaaggaagagttgcccgt

SEQ ID NO: 53154 - DNA, 20 bp, Artificial Sequence
  sgRNA
  Siglec1_13
gcacaggagctgaatgtagt

SEQ ID NO: 53155 - DNA, 20 bp, Artificial Sequence
  sgRNA
  Siglec1_14
gctcggccctagcaatcaag

SEQ ID NO: 53156 - DNA, 20 bp, Artificial Sequence
  sgRNA
  Siglec1_15
cattgggcgcacacagtagt

SEQ ID NO: 53157 - DNA, 20 bp, Artificial Sequence
  sgRNA
  Siglec1_16
gcattgcagccataagtctg

SEQ ID NO: 53158 - DNA, 20 bp, Artificial Sequence
  sgRNA
  Siglec1_17
gcagaggtagtggccccggt

SEQ ID NO: 53159 - DNA, 20 bp, Artificial Sequence
  sgRNA
  Siglec1_18
tcgtccatccccgactccag

SEQ ID NO: 53160 - DNA, 20 bp, Artificial Sequence
  sgRNA
  Siglec1_19
ggtcgtgattcagtgcaccg

SEQ ID NO: 53161 - DNA, 20 bp, Artificial Sequence
  sgRNA
  Siglec1_20
gctactgtggtgctgtcaca

SEQ ID NO: 53162 - DNA, 20 bp, Artificial Sequence
  sgRNA
  Siglec15_1
tctcaccagtcacgcgcaga

SEQ ID NO: 53163 - DNA, 20 bp, Artificial Sequence
  sgRNA
  Siglec15_2
ccactacgacgggccgctga

SEQ ID NO: 53164 - DNA, 20 bp, Artificial Sequence
  sgRNA
  Siglec15_3
agggacaggtcgttgcggcg

SEQ ID NO: 53165 - DNA, 20 bp, Artificial Sequence
  sgRNA
  Siglec15_4
ggtgcccgcggaggtgaacg

SEQ ID NO: 53166 - DNA, 20 bp, Artificial Sequence
  sgRNA
  Siglec15_5
accgagatgttgacgatccg

SEQ ID NO: 53167 - DNA, 20 bp, Artificial Sequence
  sgRNA
  Siglec15_6
gcgactctcatagcgatcgt

SEQ ID NO: 53168 - DNA, 20 bp, Artificial Sequence
  sgRNA
  Siglec15_7
tcagcggcccgtcgtagtgg

SEQ ID NO: 53169 - DNA, 20 bp, Artificial Sequence
  sgRNA
  Siglec15_8
cgtcgccggtgaactccacg

SEQ ID NO: 53170 - DNA, 20 bp, Artificial Sequence
  sgRNA
  Siglec15_9
gcaggtgttccgctgcaccg

SEQ ID NO: 53171 - DNA, 20 bp, Artificial Sequence
  sgRNA
  Siglec15_10
tcacgcgcagacggacccca

SEQ ID NO: 53172 - DNA, 20 bp, Artificial Sequence
  sgRNA
  Siglec15_11
cggccgctacttctgccgcg

SEQ ID NO: 53173 - DNA, 20 bp, Artificial Sequence
  sgRNA
  Siglec15_12
cgacggccgctacacgtgca

SEQ ID NO: 53174 - DNA, 20 bp, Artificial Sequence
  sgRNA
  Siglec15_13
caatagcctgggccgcgccg

SEQ ID NO: 53175 - DNA, 20 bp, Artificial Sequence
  sgRNA
  Siglec15_14
gaacaggtagacgctggcct

SEQ ID NO: 53176 - DNA, 20 bp, Artificial Sequence
  sgRNA
  Siglec15_15
actccacgcggcagaagtag

SEQ ID NO: 53177 - DNA, 20 bp, Artificial Sequence
  sgRNA
  Siglec15_16
gagcgccagatggccgtcag

SEQ ID NO: 53178 - DNA, 20 bp, Artificial Sequence
  sgRNA
  Siglec15_17
cagacggcgctgagcctgca

SEQ ID NO: 53179 - DNA, 20 bp, Artificial Sequence
  sgRNA
  Siglec15_18
atagcgatcgtgggcgtcgc

SEQ ID NO: 53180 - DNA, 20 bp, Artificial Sequence
  sgRNA
  Siglec15_19
tcgaccctagcgctcctgct

SEQ ID NO: 53181 - DNA, 20 bp, Artificial Sequence
  sgRNA
  Siglec15_20
gtctacctgttccgcttcca

SEQ ID NO: 53182 - DNA, 20 bp, Artificial Sequence
  sgRNA
  Siglece_1
gaccagcttaggttcgcagg

SEQ ID NO: 53183 - DNA, 20 bp, Artificial Sequence
  sgRNA
  Siglece_2
catgtgggacaagatgactc

SEQ ID NO: 53184 - DNA, 20 bp, Artificial Sequence
  sgRNA
  Siglece_3
tgtaccagaatccatgaact

SEQ ID NO: 53185 - DNA, 20 bp, Artificial Sequence
  sgRNA
  Siglece_4
cctcacatgacacgttgaga

SEQ ID NO: 53186 - DNA, 20 bp, Artificial Sequence
  sgRNA
  Siglece_5
agatcagaaagaaggatgcg

SEQ ID NO: 53187 - DNA, 20 bp, Artificial Sequence
  sgRNA
  Siglece_6
tttccagtgcatcttaagca

SEQ ID NO: 53188 - DNA, 20 bp, Artificial Sequence
  sgRNA
  Siglece_7
ggaccagcttaggttcgcag

SEQ ID NO: 53189 - DNA, 20 bp, Artificial Sequence
  sgRNA
  Siglece_8
agtttccacaaaggaccgca

SEQ ID NO: 53190 - DNA, 20 bp, Artificial Sequence
  sgRNA
  Siglece_9
gtaccagtccaggagaagat

SEQ ID NO: 53191 - DNA, 20 bp, Artificial Sequence
  sgRNA
  Siglece_10
cttcatctcgtgaaagctga

SEQ ID NO: 53192 - DNA, 20 bp, Artificial Sequence
  sgRNA
  Siglece_11
aggaccagcttaggttcgca

SEQ ID NO: 53193 - DNA, 20 bp, Artificial Sequence
  sgRNA
  Siglece_12
gatggaatctttgcgtctgt

SEQ ID NO: 53194 - DNA, 20 bp, Artificial Sequence
  sgRNA
  Siglece_13
ggagggtcagaacccccaag

SEQ ID NO: 53195 - DNA, 20 bp, Artificial Sequence
  sgRNA
  Siglece_14
ccagtgcatcttaagcacgg

SEQ ID NO: 53196 - DNA, 20 bp, Artificial Sequence
  sgRNA
  Siglece_15
ggggcaacaggacactacca

SEQ ID NO: 53197 - DNA, 20 bp, Artificial Sequence
  sgRNA
  Siglece_16
ggggttatacttctttcgcc

SEQ ID NO: 53198 - DNA, 20 bp, Artificial Sequence
  sgRNA
  Siglece_17
ctttatctctgagtactccg

SEQ ID NO: 53199 - DNA, 20 bp, Artificial Sequence
  sgRNA
  Siglece_18
ctccgggagaagaatttggg

SEQ ID NO: 53200 - DNA, 20 bp, Artificial Sequence
  sgRNA
  Siglece_19
gcttcatctcgtgaaagctg

SEQ ID NO: 53201 - DNA, 20 bp, Artificial Sequence
  sgRNA
  Siglece_20
tgtgactcctgaacccacaa

SEQ ID NO: 53202 - DNA, 20 bp, Artificial Sequence
  sgRNA
  Siglecf_1
aaggtcgattctatctcatg

SEQ ID NO: 53203 - DNA, 20 bp, Artificial Sequence
  sgRNA
  Siglecf_2
agcatctctgcagatccaag

SEQ ID NO: 53204 - DNA, 20 bp, Artificial Sequence
  sgRNA
  Siglecf_3
catccaagtcacatctaccc

SEQ ID NO: 53205 - DNA, 20 bp, Artificial Sequence
  sgRNA
  Siglecf_4
ccttatgctgaggctcacag

SEQ ID NO: 53206 - DNA, 20 bp, Artificial Sequence
  sgRNA
  Siglecf_5
tggcagttgcagttccgcgg

SEQ ID NO: 53207 - DNA, 20 bp, Artificial Sequence
  sgRNA
  Siglecf_6
cttccagctctctacccccg

SEQ ID NO: 53208 - DNA, 20 bp, Artificial Sequence
  sgRNA
  Siglecf_7
cgggcgctcccaactcagca

SEQ ID NO: 53209 - DNA, 20 bp, Artificial Sequence
  sgRNA
  Siglecf_8
ggaactaaagtcctgcagag

SEQ ID NO: 53210 - DNA, 20 bp, Artificial Sequence
  sgRNA
  Siglecf_9
ggtagaattgccagacacca

SEQ ID NO: 53211 - DNA, 20 bp, Artificial Sequence
  sgRNA
  Siglecf_10
ggaccctcctgctccttcga

SEQ ID NO: 53212 - DNA, 20 bp, Artificial Sequence
  sgRNA
  Siglecf_11
gtggcagttgcagttccgcg

SEQ ID NO: 53213 - DNA, 20 bp, Artificial Sequence
  sgRNA
  Siglecf_12
gctttgctaacagaaacaat

SEQ ID NO: 53214 - DNA, 20 bp, Artificial Sequence
  sgRNA
  Siglecf_13
ggaactgcaactgccacggg

SEQ ID NO: 53215 - DNA, 20 bp, Artificial Sequence
  sgRNA
  Siglecf_14
tggtcctccaactccgcccg

SEQ ID NO: 53216 - DNA, 20 bp, Artificial Sequence
  sgRNA
  Siglecf_15
tgaccctcgaaggagcagga

SEQ ID NO: 53217 - DNA, 20 bp, Artificial Sequence
  sgRNA
  Siglecf_16
gcactggtgttactgtggag

SEQ ID NO: 53218 - DNA, 20 bp, Artificial Sequence
  sgRNA
  Siglecf_17
agggtcatctgaatgaacca

SEQ ID NO: 53219 - DNA, 20 bp, Artificial Sequence
  sgRNA
  Siglecf_18
ctttggctactggttccggg

SEQ ID NO: 53220 - DNA, 20 bp, Artificial Sequence
  sgRNA
  Siglecf_19
ccgtggcagttgcagttccg

SEQ ID NO: 53221 - DNA, 20 bp, Artificial Sequence
  sgRNA
  Siglecf_20
acgtacttcttcagattgga

SEQ ID NO: 53222 - DNA, 20 bp, Artificial Sequence
  sgRNA
  Siglecg_1
gaaccagtagccataaagtg

SEQ ID NO: 53223 - DNA, 20 bp, Artificial Sequence
  sgRNA
  Siglecg_2
tgagagattcagtttcaagg

SEQ ID NO: 53224 - DNA, 20 bp, Artificial Sequence
  sgRNA
  Siglecg_3
aaggactgtccgactaagag

SEQ ID NO: 53225 - DNA, 20 bp, Artificial Sequence
  sgRNA
  Siglecg_4
cttcattgcagaccccccac

SEQ ID NO: 53226 - DNA, 20 bp, Artificial Sequence
  sgRNA
  Siglecg_5
gatggagagctacttcctac

SEQ ID NO: 53227 - DNA, 20 bp, Artificial Sequence
  sgRNA
  Siglecg_6
gctggctgtcagcagtacag

SEQ ID NO: 53228 - DNA, 20 bp, Artificial Sequence
  sgRNA
  Siglecg_7
tctcaaatcctctctccatc

SEQ ID NO: 53229 - DNA, 20 bp, Artificial Sequence
  sgRNA
  Siglecg_8
cccagtctctgagaataacc

SEQ ID NO: 53230 - DNA, 20 bp, Artificial Sequence
  sgRNA
  Siglecg_9
acaggtgcagagaattgtga

SEQ ID NO: 53231 - DNA, 20 bp, Artificial Sequence
  sgRNA
  Siglecg_10
gctgatagcaagagatctgg

SEQ ID NO: 53232 - DNA, 20 bp, Artificial Sequence
  sgRNA
  Siglecg_11
ccagggcagctctagtgcca

SEQ ID NO: 53233 - DNA, 20 bp, Artificial Sequence
  sgRNA
  Siglecg_12
tgttagaatgggaagcccga

SEQ ID NO: 53234 - DNA, 20 bp, Artificial Sequence
  sgRNA
  Siglecg_13
gagtccccagctttcaccca

SEQ ID NO: 53235 - DNA, 20 bp, Artificial Sequence
  sgRNA
  Siglecg_14
ctcagggagctgttgaccca

SEQ ID NO: 53236 - DNA, 20 bp, Artificial Sequence
  sgRNA
  Siglecg_15
tcacatctggaagttcagca

SEQ ID NO: 53237 - DNA, 20 bp, Artificial Sequence
  sgRNA
  Siglecg_16
cacctattctgattacacag

SEQ ID NO: 53238 - DNA, 20 bp, Artificial Sequence
  sgRNA
  Siglecg_17
ggacccagctcagtgtagca

SEQ ID NO: 53239 - DNA, 20 bp, Artificial Sequence
  sgRNA
  Siglecg_18
tcacaattctctgcacctgt

SEQ ID NO: 53240 - DNA, 20 bp, Artificial Sequence
  sgRNA
  Siglecg_19
tgctccttctcctcccctga

SEQ ID NO: 53241 - DNA, 20 bp, Artificial Sequence
  sgRNA
  Siglecg_20
gggtctcctgcagtctcagg

SEQ ID NO: 53242 - DNA, 20 bp, Artificial Sequence
  sgRNA
  Siglech_1
gatgcacaaaagggtgacaa

SEQ ID NO: 53243 - DNA, 20 bp, Artificial Sequence
  sgRNA
  Siglech_2
caaaacatggaatttctgtg

SEQ ID NO: 53244 - DNA, 20 bp, Artificial Sequence
  sgRNA
  Siglech_3
gttccccgttcacaagccca

SEQ ID NO: 53245 - DNA, 20 bp, Artificial Sequence
  sgRNA
  Siglech_4
actgaggagagtgtggtcgt

SEQ ID NO: 53246 - DNA, 20 bp, Artificial Sequence
  sgRNA
  Siglech_5
gggcacagagcacatcacat

SEQ ID NO: 53247 - DNA, 20 bp, Artificial Sequence
  sgRNA
  Siglech_6
tcagctgccctcatatccct

SEQ ID NO: 53248 - DNA, 20 bp, Artificial Sequence
  sgRNA
  Siglech_7
gggtactcaatgaggtggca

SEQ ID NO: 53249 - DNA, 20 bp, Artificial Sequence
  sgRNA
  Siglech_8
cacttaagcacccagagcaa

SEQ ID NO: 53250 - DNA, 20 bp, Artificial Sequence
  sgRNA
  Siglech_9
gcatctgaccacctgttcat

SEQ ID NO: 53251 - DNA, 20 bp, Artificial Sequence
  sgRNA
  Siglech_10
gagccgattccacttctctg

SEQ ID NO: 53252 - DNA, 20 bp, Artificial Sequence
  sgRNA
  Siglech_11
ttcatggaaccagtacccaa

SEQ ID NO: 53253 - DNA, 20 bp, Artificial Sequence
  sgRNA
  Siglech_12
ttgagtaccccatgaacagg

SEQ ID NO: 53254 - DNA, 20 bp, Artificial Sequence
  sgRNA
  Siglech_13
cagtctgtgacggtgcagga

SEQ ID NO: 53255 - DNA, 20 bp, Artificial Sequence
  sgRNA
  Siglech_14
ggtggtcagatgctgccttt

SEQ ID NO: 53256 - DNA, 20 bp, Artificial Sequence
  sgRNA
  Siglech_15
gatgtggtacaggtagccat

SEQ ID NO: 53257 - DNA, 20 bp, Artificial Sequence
  sgRNA
  Siglech_16
ctacctgtaccacatctgcc

SEQ ID NO: 53258 - DNA, 20 bp, Artificial Sequence
  sgRNA
  Siglech_17
agatggctggcattacacca

SEQ ID NO: 53259 - DNA, 20 bp, Artificial Sequence
  sgRNA
  Siglech_18
tgtaactccagtgtcagtga

SEQ ID NO: 53260 - DNA, 20 bp, Artificial Sequence
  sgRNA
  Siglech_19
tttgatagccgcttctccca

SEQ ID NO: 53261 - DNA, 20 bp, Artificial Sequence
  sgRNA
  Siglech_20
tacgtatccgtcactgacac

SEQ ID NO: 53262 - DNA, 20 bp, Artificial Sequence
  sgRNA
  Sit1_1
actgacgatcaactcgcatg

SEQ ID NO: 53263 - DNA, 20 bp, Artificial Sequence
  sgRNA
  Sit1_2
ctgcaggctagtgtagcaca

SEQ ID NO: 53264 - DNA, 20 bp, Artificial Sequence
  sgRNA
  Sit1_3
ggtcggagaaggaaccagga

SEQ ID NO: 53265 - DNA, 20 bp, Artificial Sequence
  sgRNA
  Sit1_4
gtcggctgtctcaagaacca

SEQ ID NO: 53266 - DNA, 20 bp, Artificial Sequence
  sgRNA
  Sit1_5
gcgggtctgggcacacacgg

SEQ ID NO: 53267 - DNA, 20 bp, Artificial Sequence
  sgRNA
  Sit1_6
tctccgaccacgggtccact

SEQ ID NO: 53268 - DNA, 20 bp, Artificial Sequence
  sgRNA
  Sit1_7
ccccacgcgtggcttatgga

SEQ ID NO: 53269 - DNA, 20 bp, Artificial Sequence
  sgRNA
  Sit1_8
tgtcccagtggacccgtggt

SEQ ID NO: 53270 - DNA, 20 bp, Artificial Sequence
  sgRNA
  Sit1_9
gcaccgtcacaactcctaag

SEQ ID NO: 53271 - DNA, 20 bp, Artificial Sequence
  sgRNA
  Sit1_10
tagtgcaggttgccatacag

SEQ ID NO: 53272 - DNA, 20 bp, Artificial Sequence
  sgRNA
  Sit1_11
tcccctccataagccacgcg

SEQ ID NO: 53273 - DNA, 20 bp, Artificial Sequence
  sgRNA
  Sit1_12
ccatgcgagttgatcgtcag

SEQ ID NO: 53274 - DNA, 20 bp, Artificial Sequence
  sgRNA
  Sit1_13
ggtgctgcttctcatctcat

SEQ ID NO: 53275 - DNA, 20 bp, Artificial Sequence
  sgRNA
  Sit1_14
cactgacgatcaactcgcat

SEQ ID NO: 53276 - DNA, 20 bp, Artificial Sequence
  sgRNA
  Sit1_15
tggtcggagaaggaaccagg

SEQ ID NO: 53277 - DNA, 20 bp, Artificial Sequence
  sgRNA
  Sit1_16
atagtgcaggttgccataca

SEQ ID NO: 53278 - DNA, 20 bp, Artificial Sequence
  sgRNA
  Sit1_17
cttgatctgggaaggaagcc

SEQ ID NO: 53279 - DNA, 20 bp, Artificial Sequence
  sgRNA
  Sit1_18
tgcactatttacagacaggt

SEQ ID NO: 53280 - DNA, 20 bp, Artificial Sequence
  sgRNA
  Sit1_19
ctcttgtcccagtggacccg

SEQ ID NO: 53281 - DNA, 20 bp, Artificial Sequence
  sgRNA
  Sit1_20
atacaggggaacttcttccg

SEQ ID NO: 53282 - DNA, 20 bp, Artificial Sequence
  sgRNA
  Skint7_1
tgtttatattatgaattcgg

SEQ ID NO: 53283 - DNA, 20 bp, Artificial Sequence
  sgRNA
  Skint7_2
tggtagtggcttcattgatg

SEQ ID NO: 53284 - DNA, 20 bp, Artificial Sequence
  sgRNA
  Skint7_3
cctgtttacctatacagagg

SEQ ID NO: 53285 - DNA, 20 bp, Artificial Sequence
  sgRNA
  Skint7_4
tgatgcatatggaggtacgc

SEQ ID NO: 53286 - DNA, 20 bp, Artificial Sequence
  sgRNA
  Skint7_5
tggtggagtgtaattcagga

SEQ ID NO: 53287 - DNA, 20 bp, Artificial Sequence
  sgRNA
  Skint7_6
tatttacctcaccgcagcag

SEQ ID NO: 53288 - DNA, 20 bp, Artificial Sequence
  sgRNA
  Skint7_7
taatcgggaccgtatttgga

SEQ ID NO: 53289 - DNA, 20 bp, Artificial Sequence
  sgRNA
  Skint7_8
agagagcattatccatacaa

SEQ ID NO: 53290 - DNA, 20 bp, Artificial Sequence
  sgRNA
  Skint7_9
ggagtggagagatagtaagg

SEQ ID NO: 53291 - DNA, 20 bp, Artificial Sequence
  sgRNA
  Skint7_10
tggagtgtaattcaggaggg

SEQ ID NO: 53292 - DNA, 20 bp, Artificial Sequence
  sgRNA
  Skint7_11
ccacacaaaaacatttagac

SEQ ID NO: 53293 - DNA, 20 bp, Artificial Sequence
  sgRNA
  Skint7_12
atataggcttgaggtttcat

SEQ ID NO: 53294 - DNA, 20 bp, Artificial Sequence
  sgRNA
  Skint7_13
ccttaccaatgttcatttaa

SEQ ID NO: 53295 - DNA, 20 bp, Artificial Sequence
  sgRNA
  Skint7_14
catctggcttggctgttaat

SEQ ID NO: 53296 - DNA, 20 bp, Artificial Sequence
  sgRNA
  Skint7_15
tggagtggagagatagtaag

SEQ ID NO: 53297 - DNA, 20 bp, Artificial Sequence
  sgRNA
  Skint7_16
ctaaactttccatccaaata

SEQ ID NO: 53298 - DNA, 20 bp, Artificial Sequence
  sgRNA
  Skint7_17
gactaaatgggagaagaaca

SEQ ID NO: 53299 - DNA, 20 bp, Artificial Sequence
  sgRNA
  Skint7_18
gtttatattatgaattcgga

SEQ ID NO: 53300 - DNA, 20 bp, Artificial Sequence
  sgRNA
  Skint7_19
tctttaatcgggaccgtatt

SEQ ID NO: 53301 - DNA, 20 bp, Artificial Sequence
  sgRNA
  Skint7_20
attcacaagtctgactaaat

SEQ ID NO: 53302 - DNA, 20 bp, Artificial Sequence
  sgRNA
  Skint8_1
atggtggaatgtaatacagg

SEQ ID NO: 53303 - DNA, 20 bp, Artificial Sequence
  sgRNA
  Skint8_2
tgccgtgtgacatgtttgtg

SEQ ID NO: 53304 - DNA, 20 bp, Artificial Sequence
  sgRNA
  Skint8_3
aatcaagactacttatgggt

SEQ ID NO: 53305 - DNA, 20 bp, Artificial Sequence
  sgRNA
  Skint8_4
tgatagtggctttattgatg

SEQ ID NO: 53306 - DNA, 20 bp, Artificial Sequence
  sgRNA
  Skint8_5
tatttacctcaccggtacag

SEQ ID NO: 53307 - DNA, 20 bp, Artificial Sequence
  sgRNA
  Skint8_6
tcttgattgttcttcatata

SEQ ID NO: 53308 - DNA, 20 bp, Artificial Sequence
  sgRNA
  Skint8_7
agaacaatcaagaaaaagct

SEQ ID NO: 53309 - DNA, 20 bp, Artificial Sequence
  sgRNA
  Skint8_8
tggaatgtaatacaggaggg

SEQ ID NO: 53310 - DNA, 20 bp, Artificial Sequence
  sgRNA
  Skint8_9
ccatgactccatcagcatca

SEQ ID NO: 53311 - DNA, 20 bp, Artificial Sequence
  sgRNA
  Skint8_10
acaggccaggaggtcaccac

SEQ ID NO: 53312 - DNA, 20 bp, Artificial Sequence
  sgRNA
  Skint8_11
gtttatattataaattcgga

SEQ ID NO: 53313 - DNA, 20 bp, Artificial Sequence
  sgRNA
  Skint8_12
tggtggaatgtaatacagga

SEQ ID NO: 53314 - DNA, 20 bp, Artificial Sequence
  sgRNA
  Skint8_13
ttgctgtgtatttacctcac

SEQ ID NO: 53315 - DNA, 20 bp, Artificial Sequence
  sgRNA
  Skint8_14
ctgaaaaaggagttgatgaa

SEQ ID NO: 53316 - DNA, 20 bp, Artificial Sequence
  sgRNA
  Skint8_15
ccacaggaagacatttggat

SEQ ID NO: 53317 - DNA, 20 bp, Artificial Sequence
  sgRNA
  Skint8_16
tgacatcatggatagccaac

SEQ ID NO: 53318 - DNA, 20 bp, Artificial Sequence
  sgRNA
  Skint8_17
tttcaatcaagactacttat

SEQ ID NO: 53319 - DNA, 20 bp, Artificial Sequence
  sgRNA
  Skint8_18
tcccatttagccagacatgt

SEQ ID NO: 53320 - DNA, 20 bp, Artificial Sequence
  sgRNA
  Skint8_19
tggagtggagagatagcaaa

SEQ ID NO: 53321 - DNA, 20 bp, Artificial Sequence
  sgRNA
  Skint8_20
gtgctttcattaattctctt

SEQ ID NO: 53322 - DNA, 20 bp, Artificial Sequence
  sgRNA
  Slamf1_1
atctgatgttcattcgtcag

SEQ ID NO: 53323 - DNA, 20 bp, Artificial Sequence
  sgRNA
  Slamf1_2
taaagtgctaaacaaaaccc

SEQ ID NO: 53324 - DNA, 20 bp, Artificial Sequence
  sgRNA
  Slamf1_3
gagctatccagatcacctgg

SEQ ID NO: 53325 - DNA, 20 bp, Artificial Sequence
  sgRNA
  Slamf1_4
aggatggtacttggtgagcg

SEQ ID NO: 53326 - DNA, 20 bp, Artificial Sequence
  sgRNA
  Slamf1_5
gtagctcaactcaaaagcca

SEQ ID NO: 53327 - DNA, 20 bp, Artificial Sequence
  sgRNA
  Slamf1_6
ggtcccattctcgttctcct

SEQ ID NO: 53328 - DNA, 20 bp, Artificial Sequence
  sgRNA
  Slamf1_7
gcttgcatgcttgcgatgat

SEQ ID NO: 53329 - DNA, 20 bp, Artificial Sequence
  sgRNA
  Slamf1_8
ttattattgccgtgaaaacc

SEQ ID NO: 53330 - DNA, 20 bp, Artificial Sequence
  sgRNA
  Slamf1_9
gccacataaatggttgtgca

SEQ ID NO: 53331 - DNA, 20 bp, Artificial Sequence
  sgRNA
  Slamf1_10
tgaagatcctcgggaacagg

SEQ ID NO: 53332 - DNA, 20 bp, Artificial Sequence
  sgRNA
  Slamf1_11
ttagcactttaatctctgga

SEQ ID NO: 53333 - DNA, 20 bp, Artificial Sequence
  sgRNA
  Slamf1_12
aagattataacgacccccag

SEQ ID NO: 53334 - DNA, 20 bp, Artificial Sequence
  sgRNA
  Slamf1_13
tgtccgcatcctcgtcacca

SEQ ID NO: 53335 - DNA, 20 bp, Artificial Sequence
  sgRNA
  Slamf1_14
aaatcactgccagccaccag

SEQ ID NO: 53336 - DNA, 20 bp, Artificial Sequence
  sgRNA
  Slamf1_15
gattctccagaagctgggac

SEQ ID NO: 53337 - DNA, 20 bp, Artificial Sequence
  sgRNA
  Slamf1_16
gcttcctggggacgtcgcca

SEQ ID NO: 53338 - DNA, 20 bp, Artificial Sequence
  sgRNA
  Slamf1_17
ataataatgatgaaaagaca

SEQ ID NO: 53339 - DNA, 20 bp, Artificial Sequence
  sgRNA
  Slamf1_18
gggaccatgtgacttacagc

SEQ ID NO: 53340 - DNA, 20 bp, Artificial Sequence
  sgRNA
  Slamf1_19
agaagctgggacaggacacg

SEQ ID NO: 53341 - DNA, 20 bp, Artificial Sequence
  sgRNA
  Slamf1_20
tatctgatgttcattcgtca

SEQ ID NO: 53342 - DNA, 20 bp, Artificial Sequence
  sgRNA
  Slamf6_1
gaacgccattcattagctgg

SEQ ID NO: 53343 - DNA, 20 bp, Artificial Sequence
  sgRNA
  Slamf6_2
gattacttaggttgataacg

SEQ ID NO: 53344 - DNA, 20 bp, Artificial Sequence
  sgRNA
  Slamf6_3
tgggacctgccagatacacc

SEQ ID NO: 53345 - DNA, 20 bp, Artificial Sequence
  sgRNA
  Slamf6_4
cactgcgcagataaccacaa

SEQ ID NO: 53346 - DNA, 20 bp, Artificial Sequence
  sgRNA
  Slamf6_5
gcaaatcagcaaccttacca

SEQ ID NO: 53347 - DNA, 20 bp, Artificial Sequence
  sgRNA
  Slamf6_6
agaacgccattcattagctg

SEQ ID NO: 53348 - DNA, 20 bp, Artificial Sequence
  sgRNA
  Slamf6_7
atactctcctgctagagaat

SEQ ID NO: 53349 - DNA, 20 bp, Artificial Sequence
  sgRNA
  Slamf6_8
gattcttcaaaacacaggcc

SEQ ID NO: 53350 - DNA, 20 bp, Artificial Sequence
  sgRNA
  Slamf6_9
attacttaggttgataacga

SEQ ID NO: 53351 - DNA, 20 bp, Artificial Sequence
  sgRNA
  Slamf6_10
atattggctatcttccctgc

SEQ ID NO: 53352 - DNA, 20 bp, Artificial Sequence
  sgRNA
  Slamf6_11
tcagacccccagctaatgaa

SEQ ID NO: 53353 - DNA, 20 bp, Artificial Sequence
  sgRNA
  Slamf6_12
tcatcatctggaattatgaa

SEQ ID NO: 53354 - DNA, 20 bp, Artificial Sequence
  sgRNA
  Slamf6_13
acaggaaacatctctttagg

SEQ ID NO: 53355 - DNA, 20 bp, Artificial Sequence
  sgRNA
  Slamf6_14
catcatctggaattatgaat

SEQ ID NO: 53356 - DNA, 20 bp, Artificial Sequence
  sgRNA
  Slamf6_15
gggttctaactaatccaccc

SEQ ID NO: 53357 - DNA, 20 bp, Artificial Sequence
  sgRNA
  Slamf6_16
gtatgatcctgtgtctgcca

SEQ ID NO: 53358 - DNA, 20 bp, Artificial Sequence
  sgRNA
  Slamf6_17
gtctggtcaccagaattcct

SEQ ID NO: 53359 - DNA, 20 bp, Artificial Sequence
  sgRNA
  Slamf6_18
gtcaaactgtctcagttgag

SEQ ID NO: 53360 - DNA, 20 bp, Artificial Sequence
  sgRNA
  Slamf6_19
tgtgcatacacagtgttccc

SEQ ID NO: 53361 - DNA, 20 bp, Artificial Sequence
  sgRNA
  Slamf6_20
ccagaccatcctctgacagg

SEQ ID NO: 53362 - DNA, 20 bp, Artificial Sequence
  sgRNA
  Slamf7_1
acatgtcagattgattacgc

SEQ ID NO: 53363 - DNA, 20 bp, Artificial Sequence
  sgRNA
  Slamf7_2
cctgagtgaagttagatccg

SEQ ID NO: 53364 - DNA, 20 bp, Artificial Sequence
  sgRNA
  Slamf7_3
gaatgtcacagatccatcaa

SEQ ID NO: 53365 - DNA, 20 bp, Artificial Sequence
  sgRNA
  Slamf7_4
agaccaggccttaacatgca

SEQ ID NO: 53366 - DNA, 20 bp, Artificial Sequence
  sgRNA
  Slamf7_5
aatcaatctgacatgttcca

SEQ ID NO: 53367 - DNA, 20 bp, Artificial Sequence
  sgRNA
  Slamf7_6
ccacggatctaacttcactc

SEQ ID NO: 53368 - DNA, 20 bp, Artificial Sequence
  sgRNA
  Slamf7_7
ctgcgttctcctctaagtga

SEQ ID NO: 53369 - DNA, 20 bp, Artificial Sequence
  sgRNA
  Slamf7_8
tgatctccaggcgatggaga

SEQ ID NO: 53370 - DNA, 20 bp, Artificial Sequence
  sgRNA
  Slamf7_9
cgacttgtgccctcacttag

SEQ ID NO: 53371 - DNA, 20 bp, Artificial Sequence
  sgRNA
  Slamf7_10
ctatgacacaatcccttaca

SEQ ID NO: 53372 - DNA, 20 bp, Artificial Sequence
  sgRNA
  Slamf7_11
gggagaatgtaacctacagc

SEQ ID NO: 53373 - DNA, 20 bp, Artificial Sequence
  sgRNA
  Slamf7_12
tgttagctgacagaggacag

SEQ ID NO: 53374 - DNA, 20 bp, Artificial Sequence
  sgRNA
  Slamf7_13
attctccccgtcctgatccg

SEQ ID NO: 53375 - DNA, 20 bp, Artificial Sequence
  sgRNA
  Slamf7_14
cttgccatggtaaaaaaaga

SEQ ID NO: 53376 - DNA, 20 bp, Artificial Sequence
  sgRNA
  Slamf7_15
ctgagcccgagcatgatcca

SEQ ID NO: 53377 - DNA, 20 bp, Artificial Sequence
  sgRNA
  Slamf7_16
atgtactgtaaatctctgca

SEQ ID NO: 53378 - DNA, 20 bp, Artificial Sequence
  sgRNA
  Slamf7_17
tggccatgcatgttaaggcc

SEQ ID NO: 53379 - DNA, 20 bp, Artificial Sequence
  sgRNA
  Slamf7_18
gagcttctggggaaagacgg

SEQ ID NO: 53380 - DNA, 20 bp, Artificial Sequence
  sgRNA
  Slamf7_19
atgttccacggatcaggacg

SEQ ID NO: 53381 - DNA, 20 bp, Artificial Sequence
  sgRNA
  Slamf7_20
acatgttccacggatcagga

SEQ ID NO: 53382 - DNA, 20 bp, Artificial Sequence
  sgRNA
  Slamf8_1
gtgctgatggtggatacaag

SEQ ID NO: 53383 - DNA, 20 bp, Artificial Sequence
  sgRNA
  Slamf8_2
agatgcagtacccaagcccg

SEQ ID NO: 53384 - DNA, 20 bp, Artificial Sequence
  sgRNA
  Slamf8_3
aagacctgacaggtattgag

SEQ ID NO: 53385 - DNA, 20 bp, Artificial Sequence
  sgRNA
  Slamf8_4
cagtgtccaagtgctaagca

SEQ ID NO: 53386 - DNA, 20 bp, Artificial Sequence
  sgRNA
  Slamf8_5
tcacgcacttggaagcccgg

SEQ ID NO: 53387 - DNA, 20 bp, Artificial Sequence
  sgRNA
  Slamf8_6
acataacctacagctggcga

SEQ ID NO: 53388 - DNA, 20 bp, Artificial Sequence
  sgRNA
  Slamf8_7
atatgaccacagtcaccccc

SEQ ID NO: 53389 - DNA, 20 bp, Artificial Sequence
  sgRNA
  Slamf8_8
tcagtgacataacctacagc

SEQ ID NO: 53390 - DNA, 20 bp, Artificial Sequence
  sgRNA
  Slamf8_9
tggacactgacaaccacaac

SEQ ID NO: 53391 - DNA, 20 bp, Artificial Sequence
  sgRNA
  Slamf8_10
gcaggacaagaagacctgac

SEQ ID NO: 53392 - DNA, 20 bp, Artificial Sequence
  sgRNA
  Slamf8_11
cataacctacagctggcgac

SEQ ID NO: 53393 - DNA, 20 bp, Artificial Sequence
  sgRNA
  Slamf8_12
gaaggatgcttgcactgacg

SEQ ID NO: 53394 - DNA, 20 bp, Artificial Sequence
  sgRNA
  Slamf8_13
ccaagtgctaagcaaggtag

SEQ ID NO: 53395 - DNA, 20 bp, Artificial Sequence
  sgRNA
  Slamf8_14
gctatatgacaacctcagcc

SEQ ID NO: 53396 - DNA, 20 bp, Artificial Sequence
  sgRNA
  Slamf8_15
acacctgtccatttgagaaa

SEQ ID NO: 53397 - DNA, 20 bp, Artificial Sequence
  sgRNA
  Slamf8_16
gcgatctctgtggccatcgg

SEQ ID NO: 53398 - DNA, 20 bp, Artificial Sequence
  sgRNA
  Slamf8_17
ggctgaggttgtcatatagc

SEQ ID NO: 53399 - DNA, 20 bp, Artificial Sequence
  sgRNA
  Slamf8_18
ttggacactgacaaccacaa

SEQ ID NO: 53400 - DNA, 20 bp, Artificial Sequence
  sgRNA
  Slamf8_19
agaaggatgcttgcactgac

SEQ ID NO: 53401 - DNA, 20 bp, Artificial Sequence
  sgRNA
  Slamf8_20
acactgttcctgatcctggc

SEQ ID NO: 53402 - DNA, 20 bp, Artificial Sequence
  sgRNA
  Slamf9_1
gcagtggatcctcgataccg

SEQ ID NO: 53403 - DNA, 20 bp, Artificial Sequence
  sgRNA
  Slamf9_2
gatggtaagacttcgtgatg

SEQ ID NO: 53404 - DNA, 20 bp, Artificial Sequence
  sgRNA
  Slamf9_3
agcactaacacatcccatga

SEQ ID NO: 53405 - DNA, 20 bp, Artificial Sequence
  sgRNA
  Slamf9_4
ttagagttcacagtgatgtg

SEQ ID NO: 53406 - DNA, 20 bp, Artificial Sequence
  sgRNA
  Slamf9_5
gcatattagcaatctgacct

SEQ ID NO: 53407 - DNA, 20 bp, Artificial Sequence
  sgRNA
  Slamf9_6
gaaaagctatgagacgccaa

SEQ ID NO: 53408 - DNA, 20 bp, Artificial Sequence
  sgRNA
  Slamf9_7
ctgtcctcagtacatcctgg

SEQ ID NO: 53409 - DNA, 20 bp, Artificial Sequence
  sgRNA
  Slamf9_8
tccactgccatgataacggc

SEQ ID NO: 53410 - DNA, 20 bp, Artificial Sequence
  sgRNA
  Slamf9_9
tgtgaactctaacatctcag

SEQ ID NO: 53411 - DNA, 20 bp, Artificial Sequence
  sgRNA
  Slamf9_10
aggacccaacagagatgcga

SEQ ID NO: 53412 - DNA, 20 bp, Artificial Sequence
  sgRNA
  Slamf9_11
ggtcagattgctaatatgca

SEQ ID NO: 53413 - DNA, 20 bp, Artificial Sequence
  sgRNA
  Slamf9_12
agagaaaccgcatcaaactg

SEQ ID NO: 53414 - DNA, 20 bp, Artificial Sequence
  sgRNA
  Slamf9_13
gttgctgaccctgcaagtat

SEQ ID NO: 53415 - DNA, 20 bp, Artificial Sequence
  sgRNA
  Slamf9_14
agctccttcctatacttgca

SEQ ID NO: 53416 - DNA, 20 bp, Artificial Sequence
  sgRNA
  Slamf9_15
ctgaccctgcaagtatagga

SEQ ID NO: 53417 - DNA, 20 bp, Artificial Sequence
  sgRNA
  Slamf9_16
tggatggtatttccagagag

SEQ ID NO: 53418 - DNA, 20 bp, Artificial Sequence
  sgRNA
  Slamf9_17
gcatggacgtgacctacatc

SEQ ID NO: 53419 - DNA, 20 bp, Artificial Sequence
  sgRNA
  Slamf9_18
gccagccgttatcatggcag

SEQ ID NO: 53420 - DNA, 20 bp, Artificial Sequence
  sgRNA
  Slamf9_19
cagagatgctcactctgccc

SEQ ID NO: 53421 - DNA, 20 bp, Artificial Sequence
  sgRNA
  Slamf9_20
ggacccaacagagatgcgac

SEQ ID NO: 53422 - DNA, 20 bp, Artificial Sequence
  sgRNA
  Slc10a1_1
tacagcaaaggaatctacga

SEQ ID NO: 53423 - DNA, 20 bp, Artificial Sequence
  sgRNA
  Slc10a1_2
ttaaccctcggtcctacctg

SEQ ID NO: 53424 - DNA, 20 bp, Artificial Sequence
  sgRNA
  Slc10a1_3
aggacgtagggtacatagtg

SEQ ID NO: 53425 - DNA, 20 bp, Artificial Sequence
  sgRNA
  Slc10a1_4
gaggggcatgataccgtact

SEQ ID NO: 53426 - DNA, 20 bp, Artificial Sequence
  sgRNA
  Slc10a1_5
ggacttcaggaagatcccta

SEQ ID NO: 53427 - DNA, 20 bp, Artificial Sequence
  sgRNA
  Slc10a1_6
ctatgtaccctacgtcctca

SEQ ID NO: 53428 - DNA, 20 bp, Artificial Sequence
  sgRNA
  Slc10a1_7
gataacataatgcctttgta

SEQ ID NO: 53429 - DNA, 20 bp, Artificial Sequence
  sgRNA
  Slc10a1_8
ggatcttcctgaagtccaaa

SEQ ID NO: 53430 - DNA, 20 bp, Artificial Sequence
  sgRNA
  Slc10a1_9
agtggtccaatgacttcagg

SEQ ID NO: 53431 - DNA, 20 bp, Artificial Sequence
  sgRNA
  Slc10a1_10
atcgccatagtggcccagta

SEQ ID NO: 53432 - DNA, 20 bp, Artificial Sequence
  sgRNA
  Slc10a1_11
ctgcagacgcaccatcagca

SEQ ID NO: 53433 - DNA, 20 bp, Artificial Sequence
  sgRNA
  Slc10a1_12
ttctcattccttgcgccata

SEQ ID NO: 53434 - DNA, 20 bp, Artificial Sequence
  sgRNA
  Slc10a1_13
gataccgtactgggccacta

SEQ ID NO: 53435 - DNA, 20 bp, Artificial Sequence
  sgRNA
  Slc10a1_14
gctcacttctggaagcccaa

SEQ ID NO: 53436 - DNA, 20 bp, Artificial Sequence
  sgRNA
  Slc10a1_15
ggggaaggtgacattgagga

SEQ ID NO: 53437 - DNA, 20 bp, Artificial Sequence
  sgRNA
  Slc10a1_16
gctctggccatcctcatctg

SEQ ID NO: 53438 - DNA, 20 bp, Artificial Sequence
  sgRNA
  Slc10a1_17
gtggtccaatgacttcaggg

SEQ ID NO: 53439 - DNA, 20 bp, Artificial Sequence
  sgRNA
  Slc10a1_18
ctgtagatgtataagaggag

SEQ ID NO: 53440 - DNA, 20 bp, Artificial Sequence
  sgRNA
  Slc10a1_19
gctctcgcttggctgcacca

SEQ ID NO: 53441 - DNA, 20 bp, Artificial Sequence
  sgRNA
  Slc10a1_20
ctttcatctgaccagcattg

SEQ ID NO: 53442 - DNA, 20 bp, Artificial Sequence
  sgRNA
  Slc10a2_1
ctattggatagatggcgaca

SEQ ID NO: 53443 - DNA, 20 bp, Artificial Sequence
  sgRNA
  Slc10a2_2
gttgctctcaggtactacgc

SEQ ID NO: 53444 - DNA, 20 bp, Artificial Sequence
  sgRNA
  Slc10a2_3
taggacatataaagagacca

SEQ ID NO: 53445 - DNA, 20 bp, Artificial Sequence
  sgRNA
  Slc10a2_4
gctcaccatcctcttagcca

SEQ ID NO: 53446 - DNA, 20 bp, Artificial Sequence
  sgRNA
  Slc10a2_5
tattggagccagttcctcca

SEQ ID NO: 53447 - DNA, 20 bp, Artificial Sequence
  sgRNA
  Slc10a2_6
acaccaggttgagatcctcg

SEQ ID NO: 53448 - DNA, 20 bp, Artificial Sequence
  sgRNA
  Slc10a2_7
gctgtagtggtgctaattat

SEQ ID NO: 53449 - DNA, 20 bp, Artificial Sequence
  sgRNA
  Slc10a2_8
cttcgtctacaccaagatgt

SEQ ID NO: 53450 - DNA, 20 bp, Artificial Sequence
  sgRNA
  Slc10a2_9
ggatcattgaacccaaactg

SEQ ID NO: 53451 - DNA, 20 bp, Artificial Sequence
  sgRNA
  Slc10a2_10
gtgattccctatgatagcat

SEQ ID NO: 53452 - DNA, 20 bp, Artificial Sequence
  sgRNA
  Slc10a2_11
gtgctcatagctgtgattgg

SEQ ID NO: 53453 - DNA, 20 bp, Artificial Sequence
  sgRNA
  Slc10a2_12
aagcccacgaagatacccca

SEQ ID NO: 53454 - DNA, 20 bp, Artificial Sequence
  sgRNA
  Slc10a2_13
ggaacaatattccctatagc

SEQ ID NO: 53455 - DNA, 20 bp, Artificial Sequence
  sgRNA
  Slc10a2_14
gcatgattccaaactgacag

SEQ ID NO: 53456 - DNA, 20 bp, Artificial Sequence
  sgRNA
  Slc10a2_15
gctccaatatcctggcctat

SEQ ID NO: 53457 - DNA, 20 bp, Artificial Sequence
  sgRNA
  Slc10a2_16
ctagactagctggtcaaccc

SEQ ID NO: 53458 - DNA, 20 bp, Artificial Sequence
  sgRNA
  Slc10a2_17
tcatttgatgagacaaacaa

SEQ ID NO: 53459 - DNA, 20 bp, Artificial Sequence
  sgRNA
  Slc10a2_18
gtgtagacgaagaggcaaag

SEQ ID NO: 53460 - DNA, 20 bp, Artificial Sequence
  sgRNA
  Slc10a2_19
ccccatagaaaacatcacca

SEQ ID NO: 53461 - DNA, 20 bp, Artificial Sequence
  sgRNA
  Slc10a2_20
gttcctataatccacagttt

SEQ ID NO: 53462 - DNA, 20 bp, Artificial Sequence
  sgRNA
  Slc10a3_1
ctgttcatcagcctaccatg

SEQ ID NO: 53463 - DNA, 20 bp, Artificial Sequence
  sgRNA
  Slc10a3_2
gtgatctctagccaatacac

SEQ ID NO: 53464 - DNA, 20 bp, Artificial Sequence
  sgRNA
  Slc10a3_3
tggtgttgagagcagaaggg

SEQ ID NO: 53465 - DNA, 20 bp, Artificial Sequence
  sgRNA
  Slc10a3_4
tgagagtggtaggaaaccag

SEQ ID NO: 53466 - DNA, 20 bp, Artificial Sequence
  sgRNA
  Slc10a3_5
gccatcacttgagctcccca

SEQ ID NO: 53467 - DNA, 20 bp, Artificial Sequence
  sgRNA
  Slc10a3_6
tggtaggctgatgaacagca

SEQ ID NO: 53468 - DNA, 20 bp, Artificial Sequence
  sgRNA
  Slc10a3_7
cacccctgctgatcgaagaa

SEQ ID NO: 53469 - DNA, 20 bp, Artificial Sequence
  sgRNA
  Slc10a3_8
gctgttcatcagcctaccat

SEQ ID NO: 53470 - DNA, 20 bp, Artificial Sequence
  sgRNA
  Slc10a3_9
attacctgctcatcacctgg

SEQ ID NO: 53471 - DNA, 20 bp, Artificial Sequence
  sgRNA
  Slc10a3_10
aaccaaagccaacatctcgg

SEQ ID NO: 53472 - DNA, 20 bp, Artificial Sequence
  sgRNA
  Slc10a3_11
ctaggatgaagacccccatg

SEQ ID NO: 53473 - DNA, 20 bp, Artificial Sequence
  sgRNA
  Slc10a3_12
gcctttctatgctttcctga

SEQ ID NO: 53474 - DNA, 20 bp, Artificial Sequence
  sgRNA
  Slc10a3_13
ccagctcatggatttctatg

SEQ ID NO: 53475 - DNA, 20 bp, Artificial Sequence
  sgRNA
  Slc10a3_14
tctccgttcttcgatcagca

SEQ ID NO: 53476 - DNA, 20 bp, Artificial Sequence
  sgRNA
  Slc10a3_15
ggggatggcgataaacagca

SEQ ID NO: 53477 - DNA, 20 bp, Artificial Sequence
  sgRNA
  Slc10a3_16
gtattgggttctctgagaag

SEQ ID NO: 53478 - DNA, 20 bp, Artificial Sequence
  sgRNA
  Slc10a3_17
actcagtgccacaatgaaag

SEQ ID NO: 53479 - DNA, 20 bp, Artificial Sequence
  sgRNA
  Slc10a3_18
tttgtggtaggcatccactc

SEQ ID NO: 53480 - DNA, 20 bp, Artificial Sequence
  sgRNA
  Slc10a3_19
aatacactggacagaccaat

SEQ ID NO: 53481 - DNA, 20 bp, Artificial Sequence
  sgRNA
  Slc10a3_20
tgaccagaaactggcccaag

SEQ ID NO: 53482 - DNA, 20 bp, Artificial Sequence
  sgRNA
  Slc10a5_1
tagacacaatctttaacaca

SEQ ID NO: 53483 - DNA, 20 bp, Artificial Sequence
  sgRNA
  Slc10a5_2
accccaagaagtattggcaa

SEQ ID NO: 53484 - DNA, 20 bp, Artificial Sequence
  sgRNA
  Slc10a5_3
ggatcatcgataagacaagc

SEQ ID NO: 53485 - DNA, 20 bp, Artificial Sequence
  sgRNA
  Slc10a5_4
gtcaacctgaagactttccc

SEQ ID NO: 53486 - DNA, 20 bp, Artificial Sequence
  sgRNA
  Slc10a5_5
gccccaatagaaacacctct

SEQ ID NO: 53487 - DNA, 20 bp, Artificial Sequence
  sgRNA
  Slc10a5_6
tcagaaacactagtcccatc

SEQ ID NO: 53488 - DNA, 20 bp, Artificial Sequence
  sgRNA
  Slc10a5_7
catctacttggctttccgga

SEQ ID NO: 53489 - DNA, 20 bp, Artificial Sequence
  sgRNA
  Slc10a5_8
gtagacacaatctttaacac

SEQ ID NO: 53490 - DNA, 20 bp, Artificial Sequence
  sgRNA
  Slc10a5_9
ctacctgctcgtgaagttag

SEQ ID NO: 53491 - DNA, 20 bp, Artificial Sequence
  sgRNA
  Slc10a5_10
agagcaaccgtcttgcaaac

SEQ ID NO: 53492 - DNA, 20 bp, Artificial Sequence
  sgRNA
  Slc10a5_11
agtgagagtgttcagacaga

SEQ ID NO: 53493 - DNA, 20 bp, Artificial Sequence
  sgRNA
  Slc10a5_12
cgacatggattggtgcctgg

SEQ ID NO: 53494 - DNA, 20 bp, Artificial Sequence
  sgRNA
  Slc10a5_13
ccagagctgcagggtcacat

SEQ ID NO: 53495 - DNA, 20 bp, Artificial Sequence
  sgRNA
  Slc10a5_14
atacttatgccaatgtcgac

SEQ ID NO: 53496 - DNA, 20 bp, Artificial Sequence
  sgRNA
  Slc10a5_15
gcctcttcctgtttgcaaga

SEQ ID NO: 53497 - DNA, 20 bp, Artificial Sequence
  sgRNA
  Slc10a5_16
cagcaagtagactttagcca

SEQ ID NO: 53498 - DNA, 20 bp, Artificial Sequence
  sgRNA
  Slc10a5_17
ataaccaccccaagaagtat

SEQ ID NO: 53499 - DNA, 20 bp, Artificial Sequence
  sgRNA
  Slc10a5_18
agacggttgctctcgaaact

SEQ ID NO: 53500 - DNA, 20 bp, Artificial Sequence
  sgRNA
  Slc10a5_19
agcttgactttaatgttcgt

SEQ ID NO: 53501 - DNA, 20 bp, Artificial Sequence
  sgRNA
  Slc10a5_20
tcatattctgtgctaaggga

SEQ ID NO: 53502 - DNA, 20 bp, Artificial Sequence
  sgRNA
  Slc10a6_1
tgctctgatacggaatgacg

SEQ ID NO: 53503 - DNA, 20 bp, Artificial Sequence
  sgRNA
  Slc10a6_2
ctgtgacatggccgaccaag

SEQ ID NO: 53504 - DNA, 20 bp, Artificial Sequence
  sgRNA
  Slc10a6_3
cagtaactgccaccaccagg

SEQ ID NO: 53505 - DNA, 20 bp, Artificial Sequence
  sgRNA
  Slc10a6_4
gaaggtgagaacattagaga

SEQ ID NO: 53506 - DNA, 20 bp, Artificial Sequence
  sgRNA
  Slc10a6_5
gcatggccctccattcccac

SEQ ID NO: 53507 - DNA, 20 bp, Artificial Sequence
  sgRNA
  Slc10a6_6
cagcatatcaggcatacaag

SEQ ID NO: 53508 - DNA, 20 bp, Artificial Sequence
  sgRNA
  Slc10a6_7
ttgcacctcagaagaccctg

SEQ ID NO: 53509 - DNA, 20 bp, Artificial Sequence
  sgRNA
  Slc10a6_8
gtcattccgtatcagagcat

SEQ ID NO: 53510 - DNA, 20 bp, Artificial Sequence
  sgRNA
  Slc10a6_9
gcatggtcctggcaaaaggc

SEQ ID NO: 53511 - DNA, 20 bp, Artificial Sequence
  sgRNA
  Slc10a6_10
aattacccttgtgtccctgg

SEQ ID NO: 53512 - DNA, 20 bp, Artificial Sequence
  sgRNA
  Slc10a6_11
gctaacagataagctgtcag

SEQ ID NO: 53513 - DNA, 20 bp, Artificial Sequence
  sgRNA
  Slc10a6_12
gcagccagagcagcaccaca

SEQ ID NO: 53514 - DNA, 20 bp, Artificial Sequence
  sgRNA
  Slc10a6_13
ctgccctgtcaacagtacgg

SEQ ID NO: 53515 - DNA, 20 bp, Artificial Sequence
  sgRNA
  Slc10a6_14
acggaggaagacccgcccgt

SEQ ID NO: 53516 - DNA, 20 bp, Artificial Sequence
  sgRNA
  Slc10a6_15
acatagacgccagaagccac

SEQ ID NO: 53517 - DNA, 20 bp, Artificial Sequence
  sgRNA
  Slc10a6_16
gctattgctgtcctcatgat

SEQ ID NO: 53518 - DNA, 20 bp, Artificial Sequence
  sgRNA
  Slc10a6_17
tcacccaccaatcttggcaa

SEQ ID NO: 53519 - DNA, 20 bp, Artificial Sequence
  sgRNA
  Slc10a6_18
aggcccactgcgatgcccca

SEQ ID NO: 53520 - DNA, 20 bp, Artificial Sequence
  sgRNA
  Slc10a6_19
agagaaggacagctgcagca

SEQ ID NO: 53521 - DNA, 20 bp, Artificial Sequence
  sgRNA
  Slc10a6_20
tctgcctctacatctacacc

SEQ ID NO: 53522 - DNA, 20 bp, Artificial Sequence
  sgRNA
  Slc11a1_1
gggtgtgctaccacatactg

SEQ ID NO: 53523 - DNA, 20 bp, Artificial Sequence
  sgRNA
  Slc11a1_2
gagaagtagacagaacccgc

SEQ ID NO: 53524 - DNA, 20 bp, Artificial Sequence
  sgRNA
  Slc11a1_3
cctagcatgataccgtccag

SEQ ID NO: 53525 - DNA, 20 bp, Artificial Sequence
  sgRNA
  Slc11a1_4
gaatggggatcttctcactc

SEQ ID NO: 53526 - DNA, 20 bp, Artificial Sequence
  sgRNA
  Slc11a1_5
agtagacagaacccgccggg

SEQ ID NO: 53527 - DNA, 20 bp, Artificial Sequence
  sgRNA
  Slc11a1_6
tgatgatgaaggacaccgat

SEQ ID NO: 53528 - DNA, 20 bp, Artificial Sequence
  sgRNA
  Slc11a1_7
ggaagctgtgggcgttcacg

SEQ ID NO: 53529 - DNA, 20 bp, Artificial Sequence
  sgRNA
  Slc11a1_8
gggcagagttctactatgac

SEQ ID NO: 53530 - DNA, 20 bp, Artificial Sequence
  sgRNA
  Slc11a1_9
tcgcccagagcagcacccag

SEQ ID NO: 53531 - DNA, 20 bp, Artificial Sequence
  sgRNA
  Slc11a1_10
attgagtccgaccttcaagc

SEQ ID NO: 53532 - DNA, 20 bp, Artificial Sequence
  sgRNA
  Slc11a1_11
tggacctgttgcatcgccca

SEQ ID NO: 53533 - DNA, 20 bp, Artificial Sequence
  sgRNA
  Slc11a1_12
cccagatgtagagggccgca

SEQ ID NO: 53534 - DNA, 20 bp, Artificial Sequence
  sgRNA
  Slc11a1_13
tcctcaggctgaatgtaccc

SEQ ID NO: 53535 - DNA, 20 bp, Artificial Sequence
  sgRNA
  Slc11a1_14
aagacagccaccaacacagt

SEQ ID NO: 53536 - DNA, 20 bp, Artificial Sequence
  sgRNA
  Slc11a1_15
cttctcgaacatccacccgg

SEQ ID NO: 53537 - DNA, 20 bp, Artificial Sequence
  sgRNA
  Slc11a1_16
agaagtagacagaacccgcc

SEQ ID NO: 53538 - DNA, 20 bp, Artificial Sequence
  sgRNA
  Slc11a1_17
gcgatgctcatgaggaaacc

SEQ ID NO: 53539 - DNA, 20 bp, Artificial Sequence
  sgRNA
  Slc11a1_18
tggcttctcgaacatccacc

SEQ ID NO: 53540 - DNA, 20 bp, Artificial Sequence
  sgRNA
  Slc11a1_19
ctattgcgaacagagccaca

SEQ ID NO: 53541 - DNA, 20 bp, Artificial Sequence
  sgRNA
  Slc11a1_20
acacagtgttattgtccctg

SEQ ID NO: 53542 - DNA, 20 bp, Artificial Sequence
  sgRNA
  Slc11a2_1
atgtcaccgtcagtatccca

SEQ ID NO: 53543 - DNA, 20 bp, Artificial Sequence
  sgRNA
  Slc11a2_2
aaacacaaaagtgtctgcga

SEQ ID NO: 53544 - DNA, 20 bp, Artificial Sequence
  sgRNA
  Slc11a2_3
tgagaaaatccccattcctg

SEQ ID NO: 53545 - DNA, 20 bp, Artificial Sequence
  sgRNA
  Slc11a2_4
ccttgactaaggcagaatgc

SEQ ID NO: 53546 - DNA, 20 bp, Artificial Sequence
  sgRNA
  Slc11a2_5
ctgctgagcgaagataccag

SEQ ID NO: 53547 - DNA, 20 bp, Artificial Sequence
  sgRNA
  Slc11a2_6
gcatgtggcactctatgtgg

SEQ ID NO: 53548 - DNA, 20 bp, Artificial Sequence
  sgRNA
  Slc11a2_7
tgttcgtgccgtcctgtcca

SEQ ID NO: 53549 - DNA, 20 bp, Artificial Sequence
  sgRNA
  Slc11a2_8
ggtgaatcgggccaataagc

SEQ ID NO: 53550 - DNA, 20 bp, Artificial Sequence
  sgRNA
  Slc11a2_9
actctatcttctgaacaccg

SEQ ID NO: 53551 - DNA, 20 bp, Artificial Sequence
  sgRNA
  Slc11a2_10
ggaagtcattcatccccgtt

SEQ ID NO: 53552 - DNA, 20 bp, Artificial Sequence
  sgRNA
  Slc11a2_11
gtaaactctgggcgttcacg

SEQ ID NO: 53553 - DNA, 20 bp, Artificial Sequence
  sgRNA
  Slc11a2_12
gccagagtagagttgtcact

SEQ ID NO: 53554 - DNA, 20 bp, Artificial Sequence
  sgRNA
  Slc11a2_13
tacttcagcaagatgcaagc

SEQ ID NO: 53555 - DNA, 20 bp, Artificial Sequence
  sgRNA
  Slc11a2_14
ggctgtggacatctacaaag

SEQ ID NO: 53556 - DNA, 20 bp, Artificial Sequence
  sgRNA
  Slc11a2_15
agacaggagattgatggcga

SEQ ID NO: 53557 - DNA, 20 bp, Artificial Sequence
  sgRNA
  Slc11a2_16
tcagccacaggatgatccgt

SEQ ID NO: 53558 - DNA, 20 bp, Artificial Sequence
  sgRNA
  Slc11a2_17
gggatgagttgctgtaggca

SEQ ID NO: 53559 - DNA, 20 bp, Artificial Sequence
  sgRNA
  Slc11a2_18
aggatgtggagcacctaacg

SEQ ID NO: 53560 - DNA, 20 bp, Artificial Sequence
  sgRNA
  Slc11a2_19
cctcaggtggagcaggcggt

SEQ ID NO: 53561 - DNA, 20 bp, Artificial Sequence
  sgRNA
  Slc11a2_20
ccaggatgtggagcacctaa

SEQ ID NO: 53562 - DNA, 20 bp, Artificial Sequence
  sgRNA
  Slc12a1_1
catcatcggttccatcaccg

SEQ ID NO: 53563 - DNA, 20 bp, Artificial Sequence
  sgRNA
  Slc12a1_2
acaaacggagtggtgcgagg

SEQ ID NO: 53564 - DNA, 20 bp, Artificial Sequence
  sgRNA
  Slc12a1_3
gtgggttatatccaagagag

SEQ ID NO: 53565 - DNA, 20 bp, Artificial Sequence
  sgRNA
  Slc12a1_4
ccatggctatcacaaaagtg

SEQ ID NO: 53566 - DNA, 20 bp, Artificial Sequence
  sgRNA
  Slc12a1_5
gctcgttcagtcgaacttga

SEQ ID NO: 53567 - DNA, 20 bp, Artificial Sequence
  sgRNA
  Slc12a1_6
ttatgaagagacctctttcg

SEQ ID NO: 53568 - DNA, 20 bp, Artificial Sequence
  sgRNA
  Slc12a1_7
agagtcgtaggcgtgaaacg

SEQ ID NO: 53569 - DNA, 20 bp, Artificial Sequence
  sgRNA
  Slc12a1_8
tccgtttgtggcgatagcag

SEQ ID NO: 53570 - DNA, 20 bp, Artificial Sequence
  sgRNA
  Slc12a1_9
gcaattcatcccagaaacga

SEQ ID NO: 53571 - DNA, 20 bp, Artificial Sequence
  sgRNA
  Slc12a1_10
ggcatctcggaccacacagg

SEQ ID NO: 53572 - DNA, 20 bp, Artificial Sequence
  sgRNA
  Slc12a1_11
tcagagctggagaactacgt

SEQ ID NO: 53573 - DNA, 20 bp, Artificial Sequence
  sgRNA
  Slc12a1_12
cggccttcttaaacaagcct

SEQ ID NO: 53574 - DNA, 20 bp, Artificial Sequence
  sgRNA
  Slc12a1_13
agcaacacctatgtaggcca

SEQ ID NO: 53575 - DNA, 20 bp, Artificial Sequence
  sgRNA
  Slc12a1_14
cagtgcattgtcttaacagg

SEQ ID NO: 53576 - DNA, 20 bp, Artificial Sequence
  sgRNA
  Slc12a1_15
gcaatggctctgcggcctgt

SEQ ID NO: 53577 - DNA, 20 bp, Artificial Sequence
  sgRNA
  Slc12a1_16
agcatccagtcaatgcacgt

SEQ ID NO: 53578 - DNA, 20 bp, Artificial Sequence
  sgRNA
  Slc12a1_17
ggactgcagttcttcgcaaa

SEQ ID NO: 53579 - DNA, 20 bp, Artificial Sequence
  sgRNA
  Slc12a1_18
ccatggtaacctctatcact

SEQ ID NO: 53580 - DNA, 20 bp, Artificial Sequence
  sgRNA
  Slc12a1_19
caggtccatgttataaacga

SEQ ID NO: 53581 - DNA, 20 bp, Artificial Sequence
  sgRNA
  Slc12a1_20
gggggcaatgacattcagct

SEQ ID NO: 53582 - DNA, 20 bp, Artificial Sequence
  sgRNA
  Slc12a2_1
cggtttccgagaacgccggg

SEQ ID NO: 53583 - DNA, 20 bp, Artificial Sequence
  sgRNA
  Slc12a2_2
aaacgtccctatgacgaagt

SEQ ID NO: 53584 - DNA, 20 bp, Artificial Sequence
  sgRNA
  Slc12a2_3
gttaagatgtaaccacgaag

SEQ ID NO: 53585 - DNA, 20 bp, Artificial Sequence
  sgRNA
  Slc12a2_4
tccgacaacatacatagcaa

SEQ ID NO: 53586 - DNA, 20 bp, Artificial Sequence
  sgRNA
  Slc12a2_5
acagcctgtcggatgcggcg

SEQ ID NO: 53587 - DNA, 20 bp, Artificial Sequence
  sgRNA
  Slc12a2_6
ccgggtccacgaagttcacg

SEQ ID NO: 53588 - DNA, 20 bp, Artificial Sequence
  sgRNA
  Slc12a2_7
gctgtcgtccgccgacgacg

SEQ ID NO: 53589 - DNA, 20 bp, Artificial Sequence
  sgRNA
  Slc12a2_8
cttcagcaatagctaccaat

SEQ ID NO: 53590 - DNA, 20 bp, Artificial Sequence
  sgRNA
  Slc12a2_9
gatcgaccactaccggcaca

SEQ ID NO: 53591 - DNA, 20 bp, Artificial Sequence
  sgRNA
  Slc12a2_10
aacgtgagcttccagaacgg

SEQ ID NO: 53592 - DNA, 20 bp, Artificial Sequence
  sgRNA
  Slc12a2_11
ccatcgccgacttcgtcata

SEQ ID NO: 53593 - DNA, 20 bp, Artificial Sequence
  sgRNA
  Slc12a2_12
gtagcatcctcttggccgga

SEQ ID NO: 53594 - DNA, 20 bp, Artificial Sequence
  sgRNA
  Slc12a2_13
tcattatctgtgattcgcca

SEQ ID NO: 53595 - DNA, 20 bp, Artificial Sequence
  sgRNA
  Slc12a2_14
ggggacacggtgctgagcga

SEQ ID NO: 53596 - DNA, 20 bp, Artificial Sequence
  sgRNA
  Slc12a2_15
cgtgagcttccagaacggcg

SEQ ID NO: 53597 - DNA, 20 bp, Artificial Sequence
  sgRNA
  Slc12a2_16
gatgattcccacgaaccagg

SEQ ID NO: 53598 - DNA, 20 bp, Artificial Sequence
  sgRNA
  Slc12a2_17
gccgttctggaagctcacgt

SEQ ID NO: 53599 - DNA, 20 bp, Artificial Sequence
  sgRNA
  Slc12a2_18
cggccacaacaccatggacg

SEQ ID NO: 53600 - DNA, 20 bp, Artificial Sequence
  sgRNA
  Slc12a2_19
gctaccaatgggttcgtgag

SEQ ID NO: 53601 - DNA, 20 bp, Artificial Sequence
  sgRNA
  Slc12a2_20
agttgtggttatccgcctga

SEQ ID NO: 53602 - DNA, 20 bp, Artificial Sequence
  sgRNA
  Slc12a3_1
aacctggtacccgactggag

SEQ ID NO: 53603 - DNA, 20 bp, Artificial Sequence
  sgRNA
  Slc12a3_2
cggttacaacaccatagacg

SEQ ID NO: 53604 - DNA, 20 bp, Artificial Sequence
  sgRNA
  Slc12a3_3
tgtggtcttccacctcgttg

SEQ ID NO: 53605 - DNA, 20 bp, Artificial Sequence
  sgRNA
  Slc12a3_4
cacaggctagcccttcgcag

SEQ ID NO: 53606 - DNA, 20 bp, Artificial Sequence
  sgRNA
  Slc12a3_5
ccgatactacagcaagtggg

SEQ ID NO: 53607 - DNA, 20 bp, Artificial Sequence
  sgRNA
  Slc12a3_6
cagcccagccacttaacaca

SEQ ID NO: 53608 - DNA, 20 bp, Artificial Sequence
  sgRNA
  Slc12a3_7
ttgccgtccatcaaaggcca

SEQ ID NO: 53609 - DNA, 20 bp, Artificial Sequence
  sgRNA
  Slc12a3_8
aatcatgtcctcaaaccgct

SEQ ID NO: 53610 - DNA, 20 bp, Artificial Sequence
  sgRNA
  Slc12a3_9
ggaaattgcccaactctcat

SEQ ID NO: 53611 - DNA, 20 bp, Artificial Sequence
  sgRNA
  Slc12a3_10
cttccgatactacagcaagt

SEQ ID NO: 53612 - DNA, 20 bp, Artificial Sequence
  sgRNA
  Slc12a3_11
tctggcccccaacaaacact

SEQ ID NO: 53613 - DNA, 20 bp, Artificial Sequence
  sgRNA
  Slc12a3_12
tcttcatctgagatcttcca

SEQ ID NO: 53614 - DNA, 20 bp, Artificial Sequence
  sgRNA
  Slc12a3_13
ttgtgtcatgaggatgcgcg

SEQ ID NO: 53615 - DNA, 20 bp, Artificial Sequence
  sgRNA
  Slc12a3_14
ggtacagctggtcttcacac

SEQ ID NO: 53616 - DNA, 20 bp, Artificial Sequence
  sgRNA
  Slc12a3_15
tcattgatggggtctacgat

SEQ ID NO: 53617 - DNA, 20 bp, Artificial Sequence
  sgRNA
  Slc12a3_16
agaacctgttcgcttcggct

SEQ ID NO: 53618 - DNA, 20 bp, Artificial Sequence
  sgRNA
  Slc12a3_17
gaagcagctgaaattgatga

SEQ ID NO: 53619 - DNA, 20 bp, Artificial Sequence
  sgRNA
  Slc12a3_18
ctactccgtgggcctcaacg

SEQ ID NO: 53620 - DNA, 20 bp, Artificial Sequence
  sgRNA
  Slc12a3_19
ggctagcaccatcttccagt

SEQ ID NO: 53621 - DNA, 20 bp, Artificial Sequence
  sgRNA
  Slc12a3_20
gggctttgcagaaaccgtaa

SEQ ID NO: 53622 - DNA, 20 bp, Artificial Sequence
  sgRNA
  Slc12a4_1
agcaaacggtgaaccgacgt

SEQ ID NO: 53623 - DNA, 20 bp, Artificial Sequence
  sgRNA
  Slc12a4_2
ggtggcgcttgacatgtcat

SEQ ID NO: 53624 - DNA, 20 bp, Artificial Sequence
  sgRNA
  Slc12a4_3
gttactcacggaaacacggg

SEQ ID NO: 53625 - DNA, 20 bp, Artificial Sequence
  sgRNA
  Slc12a4_4
cccagaagtctatcccagtg

SEQ ID NO: 53626 - DNA, 20 bp, Artificial Sequence
  sgRNA
  Slc12a4_5
gcaatggcttgcagtaaacg

SEQ ID NO: 53627 - DNA, 20 bp, Artificial Sequence
  sgRNA
  Slc12a4_6
gcgactatgacaacctcgag

SEQ ID NO: 53628 - DNA, 20 bp, Artificial Sequence
  sgRNA
  Slc12a4_7
ggtgcccgatgggtaaaaga

SEQ ID NO: 53629 - DNA, 20 bp, Artificial Sequence
  sgRNA
  Slc12a4_8
cggcatgagacacaactccg

SEQ ID NO: 53630 - DNA, 20 bp, Artificial Sequence
  sgRNA
  Slc12a4_9
tctctgcctatacctatgag

SEQ ID NO: 53631 - DNA, 20 bp, Artificial Sequence
  sgRNA
  Slc12a4_10
tctttgggaccagaattcgg

SEQ ID NO: 53632 - DNA, 20 bp, Artificial Sequence
  sgRNA
  Slc12a4_11
gtgttgttggtgcgtggcgg

SEQ ID NO: 53633 - DNA, 20 bp, Artificial Sequence
  sgRNA
  Slc12a4_12
atcgttggctctgtcatcca

SEQ ID NO: 53634 - DNA, 20 bp, Artificial Sequence
  sgRNA
  Slc12a4_13
cactagggcatagtaccagg

SEQ ID NO: 53635 - DNA, 20 bp, Artificial Sequence
  sgRNA
  Slc12a4_14
cggcgactatgacaacctcg

SEQ ID NO: 53636 - DNA, 20 bp, Artificial Sequence
  sgRNA
  Slc12a4_15
attccttgaagtcctaaccg

SEQ ID NO: 53637 - DNA, 20 bp, Artificial Sequence
  sgRNA
  Slc12a4_16
tctccaggtaagcgctccag

SEQ ID NO: 53638 - DNA, 20 bp, Artificial Sequence
  sgRNA
  Slc12a4_17
tgacaccgacaaacaccact

SEQ ID NO: 53639 - DNA, 20 bp, Artificial Sequence
  sgRNA
  Slc12a4_18
gagcctctactccgacgagg

SEQ ID NO: 53640 - DNA, 20 bp, Artificial Sequence
  sgRNA
  Slc12a4_19
ttgtcatagtcgccgcgtcg

SEQ ID NO: 53641 - DNA, 20 bp, Artificial Sequence
  sgRNA
  Slc12a4_20
ggcgactatgacaacctcga

SEQ ID NO: 53642 - DNA, 20 bp, Artificial Sequence
  sgRNA
  Slc12a5_1
ccaaaggggtgattgtcgag

SEQ ID NO: 53643 - DNA, 20 bp, Artificial Sequence
  sgRNA
  Slc12a5_2
agccatggcgagacagcgtg

SEQ ID NO: 53644 - DNA, 20 bp, Artificial Sequence
  sgRNA
  Slc12a5_3
tggattacagagcctcacag

SEQ ID NO: 53645 - DNA, 20 bp, Artificial Sequence
  sgRNA
  Slc12a5_4
gcaggatctcgatcgtgcca

SEQ ID NO: 53646 - DNA, 20 bp, Artificial Sequence
  sgRNA
  Slc12a5_5
gcgtaagtggtacagaaacg

SEQ ID NO: 53647 - DNA, 20 bp, Artificial Sequence
  sgRNA
  Slc12a5_6
ggtgggacacaccatcacgc

SEQ ID NO: 53648 - DNA, 20 bp, Artificial Sequence
  sgRNA
  Slc12a5_7
tattgtgttgcaatcccccg

SEQ ID NO: 53649 - DNA, 20 bp, Artificial Sequence
  sgRNA
  Slc12a5_8
tcatccccattgcggttgcg

SEQ ID NO: 53650 - DNA, 20 bp, Artificial Sequence
  sgRNA
  Slc12a5_9
caaaatgcggatcttcaccg

SEQ ID NO: 53651 - DNA, 20 bp, Artificial Sequence
  sgRNA
  Slc12a5_10
tgtggaccaggatcagaacg

SEQ ID NO: 53652 - DNA, 20 bp, Artificial Sequence
  sgRNA
  Slc12a5_11
aactacaccaacctacccca

SEQ ID NO: 53653 - DNA, 20 bp, Artificial Sequence
  sgRNA
  Slc12a5_12
tataggggcgacctcatcca

SEQ ID NO: 53654 - DNA, 20 bp, Artificial Sequence
  sgRNA
  Slc12a5_13
ctatgctctcttgcgcctgg

SEQ ID NO: 53655 - DNA, 20 bp, Artificial Sequence
  sgRNA
  Slc12a5_14
gatcggccaccgaatgccgg

SEQ ID NO: 53656 - DNA, 20 bp, Artificial Sequence
  sgRNA
  Slc12a5_15
ggggtggtccatgtctacgg

SEQ ID NO: 53657 - DNA, 20 bp, Artificial Sequence
  sgRNA
  Slc12a5_16
ggaacattgaggcggagccg

SEQ ID NO: 53658 - DNA, 20 bp, Artificial Sequence
  sgRNA
  Slc12a5_17
tgcacctcaccaagaacgag

SEQ ID NO: 53659 - DNA, 20 bp, Artificial Sequence
  sgRNA
  Slc12a5_18
gaccgggtgatgctggtccg

SEQ ID NO: 53660 - DNA, 20 bp, Artificial Sequence
  sgRNA
  Slc12a5_19
agagtcccgccggcattcgg

SEQ ID NO: 53661 - DNA, 20 bp, Artificial Sequence
  sgRNA
  Slc12a5_20
attgtgggctccgtccttga

SEQ ID NO: 53662 - DNA, 20 bp, Artificial Sequence
  sgRNA
  Slc12a6_1
aatccccaggatgttacgga

SEQ ID NO: 53663 - DNA, 20 bp, Artificial Sequence
  sgRNA
  Slc12a6_2
aactatacaaatctgacaca

SEQ ID NO: 53664 - DNA, 20 bp, Artificial Sequence
  sgRNA
  Slc12a6_3
aatggggggatggtatccgt

SEQ ID NO: 53665 - DNA, 20 bp, Artificial Sequence
  sgRNA
  Slc12a6_4
caagatcgacacaattacac

SEQ ID NO: 53666 - DNA, 20 bp, Artificial Sequence
  sgRNA
  Slc12a6_5
tcatcaccttcagggttccg

SEQ ID NO: 53667 - DNA, 20 bp, Artificial Sequence
  sgRNA
  Slc12a6_6
tgtcaccatgaaccgaactg

SEQ ID NO: 53668 - DNA, 20 bp, Artificial Sequence
  sgRNA
  Slc12a6_7
gagccaataacgatcaccca

SEQ ID NO: 53669 - DNA, 20 bp, Artificial Sequence
  sgRNA
  Slc12a6_8
tctcaatccaaggcattcca

SEQ ID NO: 53670 - DNA, 20 bp, Artificial Sequence
  sgRNA
  Slc12a6_9
gagtcagaactccatcacag

SEQ ID NO: 53671 - DNA, 20 bp, Artificial Sequence
  sgRNA
  Slc12a6_10
gcttggcagccaccaccaat

SEQ ID NO: 53672 - DNA, 20 bp, Artificial Sequence
  sgRNA
  Slc12a6_11
ccttatcctggccatccccg

SEQ ID NO: 53673 - DNA, 20 bp, Artificial Sequence
  sgRNA
  Slc12a6_12
gttcgctcataggctcacta

SEQ ID NO: 53674 - DNA, 20 bp, Artificial Sequence
  sgRNA
  Slc12a6_13
ataaatacatggcatcccgg

SEQ ID NO: 53675 - DNA, 20 bp, Artificial Sequence
  sgRNA
  Slc12a6_14
ggacctctgctccatcatca

SEQ ID NO: 53676 - DNA, 20 bp, Artificial Sequence
  sgRNA
  Slc12a6_15
ttgtgggctctgtcatcgtg

SEQ ID NO: 53677 - DNA, 20 bp, Artificial Sequence
  sgRNA
  Slc12a6_16
ggaatgtcatcaatcttagt

SEQ ID NO: 53678 - DNA, 20 bp, Artificial Sequence
  sgRNA
  Slc12a6_17
gataaatacatggcatcccg

SEQ ID NO: 53679 - DNA, 20 bp, Artificial Sequence
  sgRNA
  Slc12a6_18
aggattctgccaattggtgg

SEQ ID NO: 53680 - DNA, 20 bp, Artificial Sequence
  sgRNA
  Slc12a6_19
cattgctgcgaacccccaac

SEQ ID NO: 53681 - DNA, 20 bp, Artificial Sequence
  sgRNA
  Slc12a6_20
ggaccaccccggaaccctga

SEQ ID NO: 53682 - DNA, 20 bp, Artificial Sequence
  sgRNA
  Slc12a7_1
aatgaaagatgtagtcacga

SEQ ID NO: 53683 - DNA, 20 bp, Artificial Sequence
  sgRNA
  Slc12a7_2
aacaacgttactgagataca

SEQ ID NO: 53684 - DNA, 20 bp, Artificial Sequence
  sgRNA
  Slc12a7_3
tggtcatggaaaggccaacg

SEQ ID NO: 53685 - DNA, 20 bp, Artificial Sequence
  sgRNA
  Slc12a7_4
agcagatgaacatcagcgcg

SEQ ID NO: 53686 - DNA, 20 bp, Artificial Sequence
  sgRNA
  Slc12a7_5
tctgactcgttggttggcgg

SEQ ID NO: 53687 - DNA, 20 bp, Artificial Sequence
  sgRNA
  Slc12a7_6
ggcaggatccaaccgctccg

SEQ ID NO: 53688 - DNA, 20 bp, Artificial Sequence
  sgRNA
  Slc12a7_7
gatgattccgtcacgcgcaa

SEQ ID NO: 53689 - DNA, 20 bp, Artificial Sequence
  sgRNA
  Slc12a7_8
agacaccactggccacacca

SEQ ID NO: 53690 - DNA, 20 bp, Artificial Sequence
  sgRNA
  Slc12a7_9
gcgacgggaacattgatgtg

SEQ ID NO: 53691 - DNA, 20 bp, Artificial Sequence
  sgRNA
  Slc12a7_10
gcccttccgtcaggacctcg

SEQ ID NO: 53692 - DNA, 20 bp, Artificial Sequence
  sgRNA
  Slc12a7_11
ggagttcctcgaggtcctga

SEQ ID NO: 53693 - DNA, 20 bp, Artificial Sequence
  sgRNA
  Slc12a7_12
cgtagttctcaacaagtccc

SEQ ID NO: 53694 - DNA, 20 bp, Artificial Sequence
  sgRNA
  Slc12a7_13
aacgagtcagagcggcccag

SEQ ID NO: 53695 - DNA, 20 bp, Artificial Sequence
  sgRNA
  Slc12a7_14
gttggcctctgcttctactt

SEQ ID NO: 53696 - DNA, 20 bp, Artificial Sequence
  sgRNA
  Slc12a7_15
tcagcagtgatgacaccatg

SEQ ID NO: 53697 - DNA, 20 bp, Artificial Sequence
  sgRNA
  Slc12a7_16
atgagcgccatcgctaccaa

SEQ ID NO: 53698 - DNA, 20 bp, Artificial Sequence
  sgRNA
  Slc12a7_17
tgcgtcccacctgatccagt

SEQ ID NO: 53699 - DNA, 20 bp, Artificial Sequence
  sgRNA
  Slc12a7_18
ccacctcaggatcagtgccg

SEQ ID NO: 53700 - DNA, 20 bp, Artificial Sequence
  sgRNA
  Slc12a7_19
agttgcgatttgccagcgtg

SEQ ID NO: 53701 - DNA, 20 bp, Artificial Sequence
  sgRNA
  Slc12a7_20
acatgatctcccgttcgctg

SEQ ID NO: 53702 - DNA, 20 bp, Artificial Sequence
  sgRNA
  Slc12a8_1
catctgcccaccaagcaccg

SEQ ID NO: 53703 - DNA, 20 bp, Artificial Sequence
  sgRNA
  Slc12a8_2
cagtgaagaatgactccccg

SEQ ID NO: 53704 - DNA, 20 bp, Artificial Sequence
  sgRNA
  Slc12a8_3
gaaagggccaaataaaacac

SEQ ID NO: 53705 - DNA, 20 bp, Artificial Sequence
  sgRNA
  Slc12a8_4
ccagttcctctattggctgg

SEQ ID NO: 53706 - DNA, 20 bp, Artificial Sequence
  sgRNA
  Slc12a8_5
gtccttggtgaactccagca

SEQ ID NO: 53707 - DNA, 20 bp, Artificial Sequence
  sgRNA
  Slc12a8_6
tggtgccgtctgtacccgag

SEQ ID NO: 53708 - DNA, 20 bp, Artificial Sequence
  sgRNA
  Slc12a8_7
gatcctgcagtgcatcgccc

SEQ ID NO: 53709 - DNA, 20 bp, Artificial Sequence
  sgRNA
  Slc12a8_8
tctgccagagtacagccccg

SEQ ID NO: 53710 - DNA, 20 bp, Artificial Sequence
  sgRNA
  Slc12a8_9
attctgccagagtacagccc

SEQ ID NO: 53711 - DNA, 20 bp, Artificial Sequence
  sgRNA
  Slc12a8_10
gcacggtgatgagggccacg

SEQ ID NO: 53712 - DNA, 20 bp, Artificial Sequence
  sgRNA
  Slc12a8_11
agaagtctgctgcttctgat

SEQ ID NO: 53713 - DNA, 20 bp, Artificial Sequence
  sgRNA
  Slc12a8_12
tatcaggaagtcagagcgga

SEQ ID NO: 53714 - DNA, 20 bp, Artificial Sequence
  sgRNA
  Slc12a8_13
gggacatcagagccgtagct

SEQ ID NO: 53715 - DNA, 20 bp, Artificial Sequence
  sgRNA
  Slc12a8_14
gtggtggtaacgatctcggg

SEQ ID NO: 53716 - DNA, 20 bp, Artificial Sequence
  sgRNA
  Slc12a8_15
catgctgacctacatcatgg

SEQ ID NO: 53717 - DNA, 20 bp, Artificial Sequence
  sgRNA
  Slc12a8_16
tcgccagaaaggcgagtgca

SEQ ID NO: 53718 - DNA, 20 bp, Artificial Sequence
  sgRNA
  Slc12a8_17
ccagggtcgagacagccagc

SEQ ID NO: 53719 - DNA, 20 bp, Artificial Sequence
  sgRNA
  Slc12a8_18
gtgggcacagacctgcagga

SEQ ID NO: 53720 - DNA, 20 bp, Artificial Sequence
  sgRNA
  Slc12a8_19
tcagttcctccagccaatag

SEQ ID NO: 53721 - DNA, 20 bp, Artificial Sequence
  sgRNA
  Slc12a8_20
gcgatgcactgcaggatccg

SEQ ID NO: 53722 - DNA, 20 bp, Artificial Sequence
  sgRNA
  Slc12a9_1
tagatgccgatcaacacgag

SEQ ID NO: 53723 - DNA, 20 bp, Artificial Sequence
  sgRNA
  Slc12a9_2
gccatgccggtgtggcacgg

SEQ ID NO: 53724 - DNA, 20 bp, Artificial Sequence
  sgRNA
  Slc12a9_3
gctcttctcaccgcacgagg

SEQ ID NO: 53725 - DNA, 20 bp, Artificial Sequence
  sgRNA
  Slc12a9_4
aaacacgactatgctaaaca

SEQ ID NO: 53726 - DNA, 20 bp, Artificial Sequence
  sgRNA
  Slc12a9_5
acgtagccaggtccaccccg

SEQ ID NO: 53727 - DNA, 20 bp, Artificial Sequence
  sgRNA
  Slc12a9_6
gctaaacatggacagaaccg

SEQ ID NO: 53728 - DNA, 20 bp, Artificial Sequence
  sgRNA
  Slc12a9_7
ctaaacatggacagaaccgt

SEQ ID NO: 53729 - DNA, 20 bp, Artificial Sequence
  sgRNA
  Slc12a9_8
tgagccccctgacgcacgga

SEQ ID NO: 53730 - DNA, 20 bp, Artificial Sequence
  sgRNA
  Slc12a9_9
cagcgcatgcaggatccggg

SEQ ID NO: 53731 - DNA, 20 bp, Artificial Sequence
  sgRNA
  Slc12a9_10
gatgccgatcaacacgagcg

SEQ ID NO: 53732 - DNA, 20 bp, Artificial Sequence
  sgRNA
  Slc12a9_11
gcctccatgagctctctcat

SEQ ID NO: 53733 - DNA, 20 bp, Artificial Sequence
  sgRNA
  Slc12a9_12
aagccggtaggccaaaagag

SEQ ID NO: 53734 - DNA, 20 bp, Artificial Sequence
  sgRNA
  Slc12a9_13
gctccttgcggacatccagg

SEQ ID NO: 53735 - DNA, 20 bp, Artificial Sequence
  sgRNA
  Slc12a9_14
atgctgagccccctgacgca

SEQ ID NO: 53736 - DNA, 20 bp, Artificial Sequence
  sgRNA
  Slc12a9_15
aggagcacgtaaagttctgg

SEQ ID NO: 53737 - DNA, 20 bp, Artificial Sequence
  sgRNA
  Slc12a9_16
tctcagtccccaagactacg

SEQ ID NO: 53738 - DNA, 20 bp, Artificial Sequence
  sgRNA
  Slc12a9_17
gtctatactggacgtcttcg

SEQ ID NO: 53739 - DNA, 20 bp, Artificial Sequence
  sgRNA
  Slc12a9_18
ttaaacctgctgaggccccg

SEQ ID NO: 53740 - DNA, 20 bp, Artificial Sequence
  sgRNA
  Slc12a9_19
agattccagccataaccctg

SEQ ID NO: 53741 - DNA, 20 bp, Artificial Sequence
  sgRNA
  Slc12a9_20
tcggaagtacttgctccgcc

SEQ ID NO: 53742 - DNA, 20 bp, Artificial Sequence
  sgRNA
  Slc13a1_1
aacatggggaacattaaccc

SEQ ID NO: 53743 - DNA, 20 bp, Artificial Sequence
  sgRNA
  Slc13a1_2
ttgaatctgtaacataaccc

SEQ ID NO: 53744 - DNA, 20 bp, Artificial Sequence
  sgRNA
  Slc13a1_3
aagaattagagcaaccggga

SEQ ID NO: 53745 - DNA, 20 bp, Artificial Sequence
  sgRNA
  Slc13a1_4
ggtgggctgacaacaatcac

SEQ ID NO: 53746 - DNA, 20 bp, Artificial Sequence
  sgRNA
  Slc13a1_5
gcattgggtggatttgcaac

SEQ ID NO: 53747 - DNA, 20 bp, Artificial Sequence
  sgRNA
  Slc13a1_6
gggttatgttacagattcaa

SEQ ID NO: 53748 - DNA, 20 bp, Artificial Sequence
  sgRNA
  Slc13a1_7
cagtcacaggagcaaaatat

SEQ ID NO: 53749 - DNA, 20 bp, Artificial Sequence
  sgRNA
  Slc13a1_8
atcaatgtccagtccgtggg

SEQ ID NO: 53750 - DNA, 20 bp, Artificial Sequence
  sgRNA
  Slc13a1_9
gattgttgtcagcccaccaa

SEQ ID NO: 53751 - DNA, 20 bp, Artificial Sequence
  sgRNA
  Slc13a1_10
aattctttccaagtaatcag

SEQ ID NO: 53752 - DNA, 20 bp, Artificial Sequence
  sgRNA
  Slc13a1_11
agtagagctgtgattgacag

SEQ ID NO: 53753 - DNA, 20 bp, Artificial Sequence
  sgRNA
  Slc13a1_12
gtcccgactgaaccagagca

SEQ ID NO: 53754 - DNA, 20 bp, Artificial Sequence
  sgRNA
  Slc13a1_13
gttgaatctgtaacataacc

SEQ ID NO: 53755 - DNA, 20 bp, Artificial Sequence
  sgRNA
  Slc13a1_14
gattgtcgctgcctcaactt

SEQ ID NO: 53756 - DNA, 20 bp, Artificial Sequence
  sgRNA
  Slc13a1_15
cttactcttcaaccattggt

SEQ ID NO: 53757 - DNA, 20 bp, Artificial Sequence
  sgRNA
  Slc13a1_16
agttgaggcagcgacaatca

SEQ ID NO: 53758 - DNA, 20 bp, Artificial Sequence
  sgRNA
  Slc13a1_17
acaaagttagaagcccagga

SEQ ID NO: 53759 - DNA, 20 bp, Artificial Sequence
  sgRNA
  Slc13a1_18
aacgcatgatcccaaacatg

SEQ ID NO: 53760 - DNA, 20 bp, Artificial Sequence
  sgRNA
  Slc13a1_19
ccaaaatagtgaaaaccaca

SEQ ID NO: 53761 - DNA, 20 bp, Artificial Sequence
  sgRNA
  Slc13a1_20
attccagtcattcatgccct

SEQ ID NO: 53762 - DNA, 20 bp, Artificial Sequence
  sgRNA
  Slc13a2_1
tacaccacagcagcgccatg

SEQ ID NO: 53763 - DNA, 20 bp, Artificial Sequence
  sgRNA
  Slc13a2_2
acccccgacgaacaatatgt

SEQ ID NO: 53764 - DNA, 20 bp, Artificial Sequence
  sgRNA
  Slc13a2_3
gggtgtggtacccgtcaggg

SEQ ID NO: 53765 - DNA, 20 bp, Artificial Sequence
  sgRNA
  Slc13a2_4
gctagcacggactcacaggg

SEQ ID NO: 53766 - DNA, 20 bp, Artificial Sequence
  sgRNA
  Slc13a2_5
ggattcctgctcaatatcat

SEQ ID NO: 53767 - DNA, 20 bp, Artificial Sequence
  sgRNA
  Slc13a2_6
tatgataaggagcactccaa

SEQ ID NO: 53768 - DNA, 20 bp, Artificial Sequence
  sgRNA
  Slc13a2_7
tggcggtacgtgctgcagcg

SEQ ID NO: 53769 - DNA, 20 bp, Artificial Sequence
  sgRNA
  Slc13a2_8
gtttggacaatgagtggcag

SEQ ID NO: 53770 - DNA, 20 bp, Artificial Sequence
  sgRNA
  Slc13a2_9
cagtagcagcaagatcacca

SEQ ID NO: 53771 - DNA, 20 bp, Artificial Sequence
  sgRNA
  Slc13a2_10
acagccatgatgctgcccat

SEQ ID NO: 53772 - DNA, 20 bp, Artificial Sequence
  sgRNA
  Slc13a2_11
ggaagcaagtccccagaagg

SEQ ID NO: 53773 - DNA, 20 bp, Artificial Sequence
  sgRNA
  Slc13a2_12
tctgatggtggccatcgccg

SEQ ID NO: 53774 - DNA, 20 bp, Artificial Sequence
  sgRNA
  Slc13a2_13
tgttgctgatccacatggag

SEQ ID NO: 53775 - DNA, 20 bp, Artificial Sequence
  sgRNA
  Slc13a2_14
tccaggactgcatacccgat

SEQ ID NO: 53776 - DNA, 20 bp, Artificial Sequence
  sgRNA
  Slc13a2_15
gttagtcctggaatcttgga

SEQ ID NO: 53777 - DNA, 20 bp, Artificial Sequence
  sgRNA
  Slc13a2_16
tagtggtgctctggttcacg

SEQ ID NO: 53778 - DNA, 20 bp, Artificial Sequence
  sgRNA
  Slc13a2_17
accaacatattgttcgtcgg

SEQ ID NO: 53779 - DNA, 20 bp, Artificial Sequence
  sgRNA
  Slc13a2_18
cttccatgatacccatcaaa

SEQ ID NO: 53780 - DNA, 20 bp, Artificial Sequence
  sgRNA
  Slc13a2_19
cttggagtgctccttatcat

SEQ ID NO: 53781 - DNA, 20 bp, Artificial Sequence
  sgRNA
  Slc13a2_20
gatgggcagaaatagtgtag

SEQ ID NO: 53782 - DNA, 20 bp, Artificial Sequence
  sgRNA
  Slc13a3_1
agtttcttgccagttcggaa

SEQ ID NO: 53783 - DNA, 20 bp, Artificial Sequence
  sgRNA
  Slc13a3_2
tccagagccagcccaccagt

SEQ ID NO: 53784 - DNA, 20 bp, Artificial Sequence
  sgRNA
  Slc13a3_3
ggctaaagcggtgatccagg

SEQ ID NO: 53785 - DNA, 20 bp, Artificial Sequence
  sgRNA
  Slc13a3_4
ccaccgtaccttgggcggca

SEQ ID NO: 53786 - DNA, 20 bp, Artificial Sequence
  sgRNA
  Slc13a3_5
gtgctctcgtcgccttcccg

SEQ ID NO: 53787 - DNA, 20 bp, Artificial Sequence
  sgRNA
  Slc13a3_6
gctcattccaccatagagga

SEQ ID NO: 53788 - DNA, 20 bp, Artificial Sequence
  sgRNA
  Slc13a3_7
atgctgttgttcctactggt

SEQ ID NO: 53789 - DNA, 20 bp, Artificial Sequence
  sgRNA
  Slc13a3_8
ggcaagaaactgcatctccg

SEQ ID NO: 53790 - DNA, 20 bp, Artificial Sequence
  sgRNA
  Slc13a3_9
ggtccttccgagcttcgcgc

SEQ ID NO: 53791 - DNA, 20 bp, Artificial Sequence
  sgRNA
  Slc13a3_10
gtaggaacaacagcatgaga

SEQ ID NO: 53792 - DNA, 20 bp, Artificial Sequence
  sgRNA
  Slc13a3_11
gcaagaaactgcatctccgt

SEQ ID NO: 53793 - DNA, 20 bp, Artificial Sequence
  sgRNA
  Slc13a3_12
ggcggtgtactggtgcacag

SEQ ID NO: 53794 - DNA, 20 bp, Artificial Sequence
  sgRNA
  Slc13a3_13
ggcctgctgatgaacctgat

SEQ ID NO: 53795 - DNA, 20 bp, Artificial Sequence
  sgRNA
  Slc13a3_14
ctgggatcatcaggtacaag

SEQ ID NO: 53796 - DNA, 20 bp, Artificial Sequence
  sgRNA
  Slc13a3_15
agaagccctcactcaagtgg

SEQ ID NO: 53797 - DNA, 20 bp, Artificial Sequence
  sgRNA
  Slc13a3_16
tctttggccagcgcgaagct

SEQ ID NO: 53798 - DNA, 20 bp, Artificial Sequence
  sgRNA
  Slc13a3_17
gctggaccccaaccagcatg

SEQ ID NO: 53799 - DNA, 20 bp, Artificial Sequence
  sgRNA
  Slc13a3_18
ccaagaaggtgtggagcgcg

SEQ ID NO: 53800 - DNA, 20 bp, Artificial Sequence
  sgRNA
  Slc13a3_19
ctgatgatcccaggcacggt

SEQ ID NO: 53801 - DNA, 20 bp, Artificial Sequence
  sgRNA
  Slc13a3_20
gttccattcctctatggcgc

SEQ ID NO: 53802 - DNA, 20 bp, Artificial Sequence
  sgRNA
  Slc13a4_1
aaacaacagacagacgtcca

SEQ ID NO: 53803 - DNA, 20 bp, Artificial Sequence
  sgRNA
  Slc13a4_2
gacggtgctgtggtttaccc

SEQ ID NO: 53804 - DNA, 20 bp, Artificial Sequence
  sgRNA
  Slc13a4_3
ggtggtcaggccaccaatgg

SEQ ID NO: 53805 - DNA, 20 bp, Artificial Sequence
  sgRNA
  Slc13a4_4
ctcagacacccagtacacag

SEQ ID NO: 53806 - DNA, 20 bp, Artificial Sequence
  sgRNA
  Slc13a4_5
accagaatgacaatctccca

SEQ ID NO: 53807 - DNA, 20 bp, Artificial Sequence
  sgRNA
  Slc13a4_6
cgccatcaagaccatgcgca

SEQ ID NO: 53808 - DNA, 20 bp, Artificial Sequence
  sgRNA
  Slc13a4_7
acgagggctgcagctccgag

SEQ ID NO: 53809 - DNA, 20 bp, Artificial Sequence
  sgRNA
  Slc13a4_8
agttcaccacctctgccgcc

SEQ ID NO: 53810 - DNA, 20 bp, Artificial Sequence
  sgRNA
  Slc13a4_9
ttcgctgtgatgctgcccgt

SEQ ID NO: 53811 - DNA, 20 bp, Artificial Sequence
  sgRNA
  Slc13a4_10
gggagttagcctcttccact

SEQ ID NO: 53812 - DNA, 20 bp, Artificial Sequence
  sgRNA
  Slc13a4_11
ggatagagcccatcatcacg

SEQ ID NO: 53813 - DNA, 20 bp, Artificial Sequence
  sgRNA
  Slc13a4_12
catcggtctggtgatcgtga

SEQ ID NO: 53814 - DNA, 20 bp, Artificial Sequence
  sgRNA
  Slc13a4_13
aggagattgacatggtaacg

SEQ ID NO: 53815 - DNA, 20 bp, Artificial Sequence
  sgRNA
  Slc13a4_14
aagtccttccacgtgatgat

SEQ ID NO: 53816 - DNA, 20 bp, Artificial Sequence
  sgRNA
  Slc13a4_15
ggtctgggagtcaatgtcat

SEQ ID NO: 53817 - DNA, 20 bp, Artificial Sequence
  sgRNA
  Slc13a4_16
gcactgccagatcaaagaca

SEQ ID NO: 53818 - DNA, 20 bp, Artificial Sequence
  sgRNA
  Slc13a4_17
catcaatccactgtacaccc

SEQ ID NO: 53819 - DNA, 20 bp, Artificial Sequence
  sgRNA
  Slc13a4_18
catctggtgcccgatccatg

SEQ ID NO: 53820 - DNA, 20 bp, Artificial Sequence
  sgRNA
  Slc13a4_19
gacgcccaccaacagcagcg

SEQ ID NO: 53821 - DNA, 20 bp, Artificial Sequence
  sgRNA
  Slc13a4_20
gtaccaccatgctgtccatg

SEQ ID NO: 53822 - DNA, 20 bp, Artificial Sequence
  sgRNA
  Slc14a1_1
aaacgtattgtagtgtcctg

SEQ ID NO: 53823 - DNA, 20 bp, Artificial Sequence
  sgRNA
  Slc14a1_2
tcatagacatagcagataca

SEQ ID NO: 53824 - DNA, 20 bp, Artificial Sequence
  sgRNA
  Slc14a1_3
aggagagcaggatagcacat

SEQ ID NO: 53825 - DNA, 20 bp, Artificial Sequence
  sgRNA
  Slc14a1_4
gttgctgacaaacaccacct

SEQ ID NO: 53826 - DNA, 20 bp, Artificial Sequence
  sgRNA
  Slc14a1_5
tatatggctgtgacaacccg

SEQ ID NO: 53827 - DNA, 20 bp, Artificial Sequence
  sgRNA
  Slc14a1_6
ttatcgcctctatttccgaa

SEQ ID NO: 53828 - DNA, 20 bp, Artificial Sequence
  sgRNA
  Slc14a1_7
agtggaatcctgattctggt

SEQ ID NO: 53829 - DNA, 20 bp, Artificial Sequence
  sgRNA
  Slc14a1_8
tatatctgaccgactcccac

SEQ ID NO: 53830 - DNA, 20 bp, Artificial Sequence
  sgRNA
  Slc14a1_9
tggcctgcattgcaattgga

SEQ ID NO: 53831 - DNA, 20 bp, Artificial Sequence
  sgRNA
  Slc14a1_10
accccggtctactttaacca

SEQ ID NO: 53832 - DNA, 20 bp, Artificial Sequence
  sgRNA
  Slc14a1_11
gatacttcgtggcatatccc

SEQ ID NO: 53833 - DNA, 20 bp, Artificial Sequence
  sgRNA
  Slc14a1_12
ctattgaagtctcttccggt

SEQ ID NO: 53834 - DNA, 20 bp, Artificial Sequence
  sgRNA
  Slc14a1_13
catggaagatagtcccacca

SEQ ID NO: 53835 - DNA, 20 bp, Artificial Sequence
  sgRNA
  Slc14a1_14
ggttgctgacaaacaccacc

SEQ ID NO: 53836 - DNA, 20 bp, Artificial Sequence
  sgRNA
  Slc14a1_15
accatggttaaagtagaccg

SEQ ID NO: 53837 - DNA, 20 bp, Artificial Sequence
  sgRNA
  Slc14a1_16
gctccgtgcccaacatcacg

SEQ ID NO: 53838 - DNA, 20 bp, Artificial Sequence
  sgRNA
  Slc14a1_17
tcaacgcgctcgagaaaacc

SEQ ID NO: 53839 - DNA, 20 bp, Artificial Sequence
  sgRNA
  Slc14a1_18
gctattgaagtctcttccgg

SEQ ID NO: 53840 - DNA, 20 bp, Artificial Sequence
  sgRNA
  Slc14a1_19
cgaaaaatcccaacatctac

SEQ ID NO: 53841 - DNA, 20 bp, Artificial Sequence
  sgRNA
  Slc14a1_20
tcgacaacgccatgttgaaa

SEQ ID NO: 53842 - DNA, 20 bp, Artificial Sequence
  sgRNA
  Slc14a2_1
gtcccagcaatcgtccacca

SEQ ID NO: 53843 - DNA, 20 bp, Artificial Sequence
  sgRNA
  Slc14a2_2
gagtaccatcttcgccaagt

SEQ ID NO: 53844 - DNA, 20 bp, Artificial Sequence
  sgRNA
  Slc14a2_3
cagcaaagtcacctacccgg

SEQ ID NO: 53845 - DNA, 20 bp, Artificial Sequence
  sgRNA
  Slc14a2_4
actcacaaagagctccactg

SEQ ID NO: 53846 - DNA, 20 bp, Artificial Sequence
  sgRNA
  Slc14a2_5
cagcaaagtcacctacccag

SEQ ID NO: 53847 - DNA, 20 bp, Artificial Sequence
  sgRNA
  Slc14a2_6
gcagccatagggtcaatcgt

SEQ ID NO: 53848 - DNA, 20 bp, Artificial Sequence
  sgRNA
  Slc14a2_7
gatagctcacggcttggaag

SEQ ID NO: 53849 - DNA, 20 bp, Artificial Sequence
  sgRNA
  Slc14a2_8
ggagtgtgttccacatcgag

SEQ ID NO: 53850 - DNA, 20 bp, Artificial Sequence
  sgRNA
  Slc14a2_9
gcagcatgcaagcaaatgag

SEQ ID NO: 53851 - DNA, 20 bp, Artificial Sequence
  sgRNA
  Slc14a2_10
acaagggcaattactactgg

SEQ ID NO: 53852 - DNA, 20 bp, Artificial Sequence
  sgRNA
  Slc14a2_11
cttcgtgcagaatccctggt

SEQ ID NO: 53853 - DNA, 20 bp, Artificial Sequence
  sgRNA
  Slc14a2_12
ggaagatgcctccagtccag

SEQ ID NO: 53854 - DNA, 20 bp, Artificial Sequence
  sgRNA
  Slc14a2_13
ggaggaaggtgagcgccgag

SEQ ID NO: 53855 - DNA, 20 bp, Artificial Sequence
  sgRNA
  Slc14a2_14
tgagtaccatcttcgccaag

SEQ ID NO: 53856 - DNA, 20 bp, Artificial Sequence
  sgRNA
  Slc14a2_15
tcgagtggtcatccatccgg

SEQ ID NO: 53857 - DNA, 20 bp, Artificial Sequence
  sgRNA
  Slc14a2_16
gcccaggtagatcgtctcaa

SEQ ID NO: 53858 - DNA, 20 bp, Artificial Sequence
  sgRNA
  Slc14a2_17
agagccatcccggttggaat

SEQ ID NO: 53859 - DNA, 20 bp, Artificial Sequence
  sgRNA
  Slc14a2_18
agctgccctctccaatacaa

SEQ ID NO: 53860 - DNA, 20 bp, Artificial Sequence
  sgRNA
  Slc14a2_19
agtcacacggatcaggccag

SEQ ID NO: 53861 - DNA, 20 bp, Artificial Sequence
  sgRNA
  Slc14a2_20
tcttcgtgcagaatccctgg

SEQ ID NO: 53862 - DNA, 20 bp, Artificial Sequence
  sgRNA
  Slc15a1_1
ttgtccaatcgtgtagacga

SEQ ID NO: 53863 - DNA, 20 bp, Artificial Sequence
  sgRNA
  Slc15a1_2
gaagtaaggcatatcccaag

SEQ ID NO: 53864 - DNA, 20 bp, Artificial Sequence
  sgRNA
  Slc15a1_3
ccaccaaacgcagacacaca

SEQ ID NO: 53865 - DNA, 20 bp, Artificial Sequence
  sgRNA
  Slc15a1_4
ctgggacgacaatctctcca

SEQ ID NO: 53866 - DNA, 20 bp, Artificial Sequence
  sgRNA
  Slc15a1_5
gtacacaataaacaccacgg

SEQ ID NO: 53867 - DNA, 20 bp, Artificial Sequence
  sgRNA
  Slc15a1_6
agagattgtcgtcccagccg

SEQ ID NO: 53868 - DNA, 20 bp, Artificial Sequence
  sgRNA
  Slc15a1_7
gtatacctacgtgatccgaa

SEQ ID NO: 53869 - DNA, 20 bp, Artificial Sequence
  sgRNA
  Slc15a1_8
ctatccatcgtctacacgat

SEQ ID NO: 53870 - DNA, 20 bp, Artificial Sequence
  sgRNA
  Slc15a1_9
ttaccacacggtattgactg

SEQ ID NO: 53871 - DNA, 20 bp, Artificial Sequence
  sgRNA
  Slc15a1_10
gcttgattcctcctgtacca

SEQ ID NO: 53872 - DNA, 20 bp, Artificial Sequence
  sgRNA
  Slc15a1_11
gctcatctcacagattaaga

SEQ ID NO: 53873 - DNA, 20 bp, Artificial Sequence
  sgRNA
  Slc15a1_12
aagtaaggcatatcccaaga

SEQ ID NO: 53874 - DNA, 20 bp, Artificial Sequence
  sgRNA
  Slc15a1_13
tttggacttgatttccacca

SEQ ID NO: 53875 - DNA, 20 bp, Artificial Sequence
  sgRNA
  Slc15a1_14
gaacgtatggtaaatggccg

SEQ ID NO: 53876 - DNA, 20 bp, Artificial Sequence
  sgRNA
  Slc15a1_15
gaaccccagtcaataccgtg

SEQ ID NO: 53877 - DNA, 20 bp, Artificial Sequence
  sgRNA
  Slc15a1_16
tatacgcgctgccaaagtca

SEQ ID NO: 53878 - DNA, 20 bp, Artificial Sequence
  sgRNA
  Slc15a1_17
gatggtgaccatctcgttaa

SEQ ID NO: 53879 - DNA, 20 bp, Artificial Sequence
  sgRNA
  Slc15a1_18
gtcaccagtcacaacgccag

SEQ ID NO: 53880 - DNA, 20 bp, Artificial Sequence
  sgRNA
  Slc15a1_19
atttggacttgatttccacc

SEQ ID NO: 53881 - DNA, 20 bp, Artificial Sequence
  sgRNA
  Slc15a1_20
tcattgtgctcatcgtggca

SEQ ID NO: 53882 - DNA, 20 bp, Artificial Sequence
  sgRNA
  Slc15a2_1
aggaggtatcaaaccctgtg

SEQ ID NO: 53883 - DNA, 20 bp, Artificial Sequence
  sgRNA
  Slc15a2_2
acattccaaagcgacaacat

SEQ ID NO: 53884 - DNA, 20 bp, Artificial Sequence
  sgRNA
  Slc15a2_3
tatcggctgatctccaagtg

SEQ ID NO: 53885 - DNA, 20 bp, Artificial Sequence
  sgRNA
  Slc15a2_4
ctgatggactccaccaagag

SEQ ID NO: 53886 - DNA, 20 bp, Artificial Sequence
  sgRNA
  Slc15a2_5
cattctcatgaaccaccaac

SEQ ID NO: 53887 - DNA, 20 bp, Artificial Sequence
  sgRNA
  Slc15a2_6
ggtgccataccaatactggg

SEQ ID NO: 53888 - DNA, 20 bp, Artificial Sequence
  sgRNA
  Slc15a2_7
caggaatcaaaccagccaat

SEQ ID NO: 53889 - DNA, 20 bp, Artificial Sequence
  sgRNA
  Slc15a2_8
acactattcgaaactacgcc

SEQ ID NO: 53890 - DNA, 20 bp, Artificial Sequence
  sgRNA
  Slc15a2_9
gtgccttcacgtccataatg

SEQ ID NO: 53891 - DNA, 20 bp, Artificial Sequence
  sgRNA
  Slc15a2_10
gagtacagaactgtgcaaag

SEQ ID NO: 53892 - DNA, 20 bp, Artificial Sequence
  sgRNA
  Slc15a2_11
tagtctttgcccacgctgag

SEQ ID NO: 53893 - DNA, 20 bp, Artificial Sequence
  sgRNA
  Slc15a2_12
cctgatggctgtcatcccat

SEQ ID NO: 53894 - DNA, 20 bp, Artificial Sequence
  sgRNA
  Slc15a2_13
ccaggcctgaagaccccggt

SEQ ID NO: 53895 - DNA, 20 bp, Artificial Sequence
  sgRNA
  Slc15a2_14
ccacaatgagtactctgtag

SEQ ID NO: 53896 - DNA, 20 bp, Artificial Sequence
  sgRNA
  Slc15a2_15
gcgacaacattggctagact

SEQ ID NO: 53897 - DNA, 20 bp, Artificial Sequence
  sgRNA
  Slc15a2_16
tggcgaagactgctatgcat

SEQ ID NO: 53898 - DNA, 20 bp, Artificial Sequence
  sgRNA
  Slc15a2_17
tccaaaagagcccagaacat

SEQ ID NO: 53899 - DNA, 20 bp, Artificial Sequence
  sgRNA
  Slc15a2_18
agatgggggtgaaatagcag

SEQ ID NO: 53900 - DNA, 20 bp, Artificial Sequence
  sgRNA
  Slc15a2_19
gcccacgctgagaggagcat

SEQ ID NO: 53901 - DNA, 20 bp, Artificial Sequence
  sgRNA
  Slc15a2_20
gccactatgttcccttcagg

SEQ ID NO: 53902 - DNA, 20 bp, Artificial Sequence
  sgRNA
  Slc15a3_1
ggtggtgagcaacaagccag

SEQ ID NO: 53903 - DNA, 20 bp, Artificial Sequence
  sgRNA
  Slc15a3_2
cagcaacaccaagtagaggg

SEQ ID NO: 53904 - DNA, 20 bp, Artificial Sequence
  sgRNA
  Slc15a3_3
cagaacatcagcttcctatg

SEQ ID NO: 53905 - DNA, 20 bp, Artificial Sequence
  sgRNA
  Slc15a3_4
caacaaagagatgttagggt

SEQ ID NO: 53906 - DNA, 20 bp, Artificial Sequence
  sgRNA
  Slc15a3_5
gttgaggtagagcacgaggt

SEQ ID NO: 53907 - DNA, 20 bp, Artificial Sequence
  sgRNA
  Slc15a3_6
ggattgctggtcgctatgag

SEQ ID NO: 53908 - DNA, 20 bp, Artificial Sequence
  sgRNA
  Slc15a3_7
tggctggcagacgtgtacct

SEQ ID NO: 53909 - DNA, 20 bp, Artificial Sequence
  sgRNA
  Slc15a3_8
ggagcagcaacaccaagtag

SEQ ID NO: 53910 - DNA, 20 bp, Artificial Sequence
  sgRNA
  Slc15a3_9
tggttgctcttccgcgcgag

SEQ ID NO: 53911 - DNA, 20 bp, Artificial Sequence
  sgRNA
  Slc15a3_10
cgttacttcttcctgctggc

SEQ ID NO: 53912 - DNA, 20 bp, Artificial Sequence
  sgRNA
  Slc15a3_11
tcgctatgagaggactcgcc

SEQ ID NO: 53913 - DNA, 20 bp, Artificial Sequence
  sgRNA
  Slc15a3_12
gtcagccccgaacgaggtga

SEQ ID NO: 53914 - DNA, 20 bp, Artificial Sequence
  sgRNA
  Slc15a3_13
gcttcagcatagatgacact

SEQ ID NO: 53915 - DNA, 20 bp, Artificial Sequence
  sgRNA
  Slc15a3_14
gcagaacatcagcttcctat

SEQ ID NO: 53916 - DNA, 20 bp, Artificial Sequence
  sgRNA
  Slc15a3_15
ggaccgttacttcttcctgc

SEQ ID NO: 53917 - DNA, 20 bp, Artificial Sequence
  sgRNA
  Slc15a3_16
tgaagaatgccaggcccacg

SEQ ID NO: 53918 - DNA, 20 bp, Artificial Sequence
  sgRNA
  Slc15a3_17
attgcaccctgcatggagcg

SEQ ID NO: 53919 - DNA, 20 bp, Artificial Sequence
  sgRNA
  Slc15a3_18
gaaccagttgaagaagcggc

SEQ ID NO: 53920 - DNA, 20 bp, Artificial Sequence
  sgRNA
  Slc15a3_19
gcctagcagtgagcccaccc

SEQ ID NO: 53921 - DNA, 20 bp, Artificial Sequence
  sgRNA
  Slc15a3_20
gggctggatgtactgcccca

SEQ ID NO: 53922 - DNA, 20 bp, Artificial Sequence
  sgRNA
  Slc15a4_1
gcgtggagggccgttcacag

SEQ ID NO: 53923 - DNA, 20 bp, Artificial Sequence
  sgRNA
  Slc15a4_2
gacacgacgctgacccgttg

SEQ ID NO: 53924 - DNA, 20 bp, Artificial Sequence
  sgRNA
  Slc15a4_3
tatcaccaccacccatcaca

SEQ ID NO: 53925 - DNA, 20 bp, Artificial Sequence
  sgRNA
  Slc15a4_4
ccaattgaaaaatctccgag

SEQ ID NO: 53926 - DNA, 20 bp, Artificial Sequence
  sgRNA
  Slc15a4_5
gattcatgtaagatgtcgcg

SEQ ID NO: 53927 - DNA, 20 bp, Artificial Sequence
  sgRNA
  Slc15a4_6
ggacgccgcgaacccaacag

SEQ ID NO: 53928 - DNA, 20 bp, Artificial Sequence
  sgRNA
  Slc15a4_7
catctgtcctggctcgctgg

SEQ ID NO: 53929 - DNA, 20 bp, Artificial Sequence
  sgRNA
  Slc15a4_8
tgcgcgccctcccagtcgaa

SEQ ID NO: 53930 - DNA, 20 bp, Artificial Sequence
  sgRNA
  Slc15a4_9
ctcgcgctccttcctctgcg

SEQ ID NO: 53931 - DNA, 20 bp, Artificial Sequence
  sgRNA
  Slc15a4_10
gtgaaggcactgccgtcagg

SEQ ID NO: 53932 - DNA, 20 bp, Artificial Sequence
  sgRNA
  Slc15a4_11
catgtaagatgtcgcgtgga

SEQ ID NO: 53933 - DNA, 20 bp, Artificial Sequence
  sgRNA
  Slc15a4_12
cacgggcacaatcttgacca

SEQ ID NO: 53934 - DNA, 20 bp, Artificial Sequence
  sgRNA
  Slc15a4_13
ttcatcaccaagcctcctga

SEQ ID NO: 53935 - DNA, 20 bp, Artificial Sequence
  sgRNA
  Slc15a4_14
atgactgctcatccacccaa

SEQ ID NO: 53936 - DNA, 20 bp, Artificial Sequence
  sgRNA
  Slc15a4_15
tatctgggctcgccgttcgg

SEQ ID NO: 53937 - DNA, 20 bp, Artificial Sequence
  sgRNA
  Slc15a4_16
cgtgatgttggccttgaccg

SEQ ID NO: 53938 - DNA, 20 bp, Artificial Sequence
  sgRNA
  Slc15a4_17
ggagcaatcctgtcattagg

SEQ ID NO: 53939 - DNA, 20 bp, Artificial Sequence
  sgRNA
  Slc15a4_18
gcattactacttcttcctgc

SEQ ID NO: 53940 - DNA, 20 bp, Artificial Sequence
  sgRNA
  Slc15a4_19
cagaggaaggagcgcgagcg

SEQ ID NO: 53941 - DNA, 20 bp, Artificial Sequence
  sgRNA
  Slc15a4_20
gatgagcaccgcatcaaaca

SEQ ID NO: 53942 - DNA, 20 bp, Artificial Sequence
  sgRNA
  Slc15a5_1
gtctgtccgccagatatgtg

SEQ ID NO: 53943 - DNA, 20 bp, Artificial Sequence
  sgRNA
  Slc15a5_2
ttgcggatgagtacttcgga

SEQ ID NO: 53944 - DNA, 20 bp, Artificial Sequence
  sgRNA
  Slc15a5_3
agcactgcgacctgatctat

SEQ ID NO: 53945 - DNA, 20 bp, Artificial Sequence
  sgRNA
  Slc15a5_4
ctgaagtaatccataaaggg

SEQ ID NO: 53946 - DNA, 20 bp, Artificial Sequence
  sgRNA
  Slc15a5_5
tggatctgcctgtttcgcag

SEQ ID NO: 53947 - DNA, 20 bp, Artificial Sequence
  sgRNA
  Slc15a5_6
aaatccaccccagttccggt

SEQ ID NO: 53948 - DNA, 20 bp, Artificial Sequence
  sgRNA
  Slc15a5_7
gggccaccatgtaagactaa

SEQ ID NO: 53949 - DNA, 20 bp, Artificial Sequence
  sgRNA
  Slc15a5_8
tggcttgcggatgagtactt

SEQ ID NO: 53950 - DNA, 20 bp, Artificial Sequence
  sgRNA
  Slc15a5_9
ttcagaccatgaattccaac

SEQ ID NO: 53951 - DNA, 20 bp, Artificial Sequence
  sgRNA
  Slc15a5_10
tcacattcaatccaagtgcg

SEQ ID NO: 53952 - DNA, 20 bp, Artificial Sequence
  sgRNA
  Slc15a5_11
tgactgccacacatatctgg

SEQ ID NO: 53953 - DNA, 20 bp, Artificial Sequence
  sgRNA
  Slc15a5_12
acaccacagtgaactccaag

SEQ ID NO: 53954 - DNA, 20 bp, Artificial Sequence
  sgRNA
  Slc15a5_13
gtaactcacagagtcatccc

SEQ ID NO: 53955 - DNA, 20 bp, Artificial Sequence
  sgRNA
  Slc15a5_14
gcttcaggtaaagagtcacc

SEQ ID NO: 53956 - DNA, 20 bp, Artificial Sequence
  sgRNA
  Slc15a5_15
gatgactctgtgagttacca

SEQ ID NO: 53957 - DNA, 20 bp, Artificial Sequence
  sgRNA
  Slc15a5_16
atgaattccaaccggaactg

SEQ ID NO: 53958 - DNA, 20 bp, Artificial Sequence
  sgRNA
  Slc15a5_17
gtctgaagataatatcctga

SEQ ID NO: 53959 - DNA, 20 bp, Artificial Sequence
  sgRNA
  Slc15a5_18
aaaaagccatggaagcgcct

SEQ ID NO: 53960 - DNA, 20 bp, Artificial Sequence
  sgRNA
  Slc15a5_19
tttaatgcccagcgcatccg

SEQ ID NO: 53961 - DNA, 20 bp, Artificial Sequence
  sgRNA
  Slc15a5_20
cgccctggcgatcgtcagga

SEQ ID NO: 53962 - DNA, 20 bp, Artificial Sequence
  sgRNA
  Slc16a1_1
actactaagaaagaccaaag

SEQ ID NO: 53963 - DNA, 20 bp, Artificial Sequence
  sgRNA
  Slc16a1_2
caccagcgatcattactgga

SEQ ID NO: 53964 - DNA, 20 bp, Artificial Sequence
  sgRNA
  Slc16a1_3
gacttgcagccaacaccaag

SEQ ID NO: 53965 - DNA, 20 bp, Artificial Sequence
  sgRNA
  Slc16a1_4
aggccctattggtctcatca

SEQ ID NO: 53966 - DNA, 20 bp, Artificial Sequence
  sgRNA
  Slc16a1_5
ctttgtctacaacctacgtt

SEQ ID NO: 53967 - DNA, 20 bp, Artificial Sequence
  sgRNA
  Slc16a1_6
gcaaaaaagtactggatccg

SEQ ID NO: 53968 - DNA, 20 bp, Artificial Sequence
  sgRNA
  Slc16a1_7
ggatccctgatgagaccaat

SEQ ID NO: 53969 - DNA, 20 bp, Artificial Sequence
  sgRNA
  Slc16a1_8
gttgggttctgtgtctacgc

SEQ ID NO: 53970 - DNA, 20 bp, Artificial Sequence
  sgRNA
  Slc16a1_9
tgccaaagaacagaaagcgg

SEQ ID NO: 53971 - DNA, 20 bp, Artificial Sequence
  sgRNA
  Slc16a1_10
gcaaatacagatctcattgg

SEQ ID NO: 53972 - DNA, 20 bp, Artificial Sequence
  sgRNA
  Slc16a1_11
acttgtcgctgtttacccat

SEQ ID NO: 53973 - DNA, 20 bp, Artificial Sequence
  sgRNA
  Slc16a1_12
cgtccagtaatgatcgctgg

SEQ ID NO: 53974 - DNA, 20 bp, Artificial Sequence
  sgRNA
  Slc16a1_13
gtagacacagaacccaacgt

SEQ ID NO: 53975 - DNA, 20 bp, Artificial Sequence
  sgRNA
  Slc16a1_14
gtacagtaaaaagcccctat

SEQ ID NO: 53976 - DNA, 20 bp, Artificial Sequence
  sgRNA
  Slc16a1_15
ctttggcttctcgtcgacat

SEQ ID NO: 53977 - DNA, 20 bp, Artificial Sequence
  sgRNA
  Slc16a1_16
cctgcgattggagggccagt

SEQ ID NO: 53978 - DNA, 20 bp, Artificial Sequence
  sgRNA
  Slc16a1_17
acagcactggagaacctctg

SEQ ID NO: 53979 - DNA, 20 bp, Artificial Sequence
  sgRNA
  Slc16a1_18
acaccaagtggatcagacct

SEQ ID NO: 53980 - DNA, 20 bp, Artificial Sequence
  sgRNA
  Slc16a1_19
ctaaaagtggtggccctagg

SEQ ID NO: 53981 - DNA, 20 bp, Artificial Sequence
  sgRNA
  Slc16a1_20
ggtacagtaaaaagccccta

SEQ ID NO: 53982 - DNA, 20 bp, Artificial Sequence
  sgRNA
  Slc16a12_1
caacaatatcgattaccccg

SEQ ID NO: 53983 - DNA, 20 bp, Artificial Sequence
  sgRNA
  Slc16a12_2
gccaggaaaactgttcgatg

SEQ ID NO: 53984 - DNA, 20 bp, Artificial Sequence
  sgRNA
  Slc16a12_3
gcttacctgtaagaactccc

SEQ ID NO: 53985 - DNA, 20 bp, Artificial Sequence
  sgRNA
  Slc16a12_4
accagttatcctgtcaagcg

SEQ ID NO: 53986 - DNA, 20 bp, Artificial Sequence
  sgRNA
  Slc16a12_5
gctgaaatacttgcccacca

SEQ ID NO: 53987 - DNA, 20 bp, Artificial Sequence
  sgRNA
  Slc16a12_6
gcttcgttagaattgtcaag

SEQ ID NO: 53988 - DNA, 20 bp, Artificial Sequence
  sgRNA
  Slc16a12_7
catctagtgccacggcaaag

SEQ ID NO: 53989 - DNA, 20 bp, Artificial Sequence
  sgRNA
  Slc16a12_8
tctttgccgtggcactagat

SEQ ID NO: 53990 - DNA, 20 bp, Artificial Sequence
  sgRNA
  Slc16a12_9
ttactctccggcaattgcca

SEQ ID NO: 53991 - DNA, 20 bp, Artificial Sequence
  sgRNA
  Slc16a12_10
tgtttgctacctctttgccg

SEQ ID NO: 53992 - DNA, 20 bp, Artificial Sequence
  sgRNA
  Slc16a12_11
gatgtcagacttcgtcgtgt

SEQ ID NO: 53993 - DNA, 20 bp, Artificial Sequence
  sgRNA
  Slc16a12_12
actatctctgcagtcacgac

SEQ ID NO: 53994 - DNA, 20 bp, Artificial Sequence
  sgRNA
  Slc16a12_13
gcactaggtacacaaagaga

SEQ ID NO: 53995 - DNA, 20 bp, Artificial Sequence
  sgRNA
  Slc16a12_14
gactgatcggtcctctttaa

SEQ ID NO: 53996 - DNA, 20 bp, Artificial Sequence
  sgRNA
  Slc16a12_15
ttactgacaacactcccaag

SEQ ID NO: 53997 - DNA, 20 bp, Artificial Sequence
  sgRNA
  Slc16a12_16
ctatctctgcagtcacgacc

SEQ ID NO: 53998 - DNA, 20 bp, Artificial Sequence
  sgRNA
  Slc16a12_17
gggattgccatgtcaggcag

SEQ ID NO: 53999 - DNA, 20 bp, Artificial Sequence
  sgRNA
  Slc16a12_18
aggattactcccaaacagca

SEQ ID NO: 54000 - DNA, 20 bp, Artificial Sequence
  sgRNA
  Slc16a12_19
ccagacctggctttaggcag

SEQ ID NO: 54001 - DNA, 20 bp, Artificial Sequence
  sgRNA
  Slc16a12_20
ggatggctggtggacacgac

SEQ ID NO: 54002 - DNA, 20 bp, Artificial Sequence
  sgRNA
  Slc16a4_1
aaggaacgtcccaagaatgg

SEQ ID NO: 54003 - DNA, 20 bp, Artificial Sequence
  sgRNA
  Slc16a4_2
caattgcccgttctggaatg

SEQ ID NO: 54004 - DNA, 20 bp, Artificial Sequence
  sgRNA
  Slc16a4_3
ctggctactaggtggaaagt

SEQ ID NO: 54005 - DNA, 20 bp, Artificial Sequence
  sgRNA
  Slc16a4_4
ttgccattgctcataagtaa

SEQ ID NO: 54006 - DNA, 20 bp, Artificial Sequence
  sgRNA
  Slc16a4_5
atactggcagtattagtgcc

SEQ ID NO: 54007 - DNA, 20 bp, Artificial Sequence
  sgRNA
  Slc16a4_6
gattacacacagacttacac

SEQ ID NO: 54008 - DNA, 20 bp, Artificial Sequence
  sgRNA
  Slc16a4_7
gcacttcagagcaaattggt

SEQ ID NO: 54009 - DNA, 20 bp, Artificial Sequence
  sgRNA
  Slc16a4_8
aggccgttacttatgagcaa

SEQ ID NO: 54010 - DNA, 20 bp, Artificial Sequence
  sgRNA
  Slc16a4_9
atgtcagccccattccagaa

SEQ ID NO: 54011 - DNA, 20 bp, Artificial Sequence
  sgRNA
  Slc16a4_10
tggtggctaaaggagcaagc

SEQ ID NO: 54012 - DNA, 20 bp, Artificial Sequence
  sgRNA
  Slc16a4_11
atagtactgtctttgatgaa

SEQ ID NO: 54013 - DNA, 20 bp, Artificial Sequence
  sgRNA
  Slc16a4_12
gatggattgctgatcaaaat

SEQ ID NO: 54014 - DNA, 20 bp, Artificial Sequence
  sgRNA
  Slc16a4_13
tgacatagccaccagagaca

SEQ ID NO: 54015 - DNA, 20 bp, Artificial Sequence
  sgRNA
  Slc16a4_14
tagccagagcaaaaacactt

SEQ ID NO: 54016 - DNA, 20 bp, Artificial Sequence
  sgRNA
  Slc16a4_15
gtactctagaattcttagat

SEQ ID NO: 54017 - DNA, 20 bp, Artificial Sequence
  sgRNA
  Slc16a4_16
gtcacagatgatagcagcca

SEQ ID NO: 54018 - DNA, 20 bp, Artificial Sequence
  sgRNA
  Slc16a4_17
tcagtcagctcatttctgga

SEQ ID NO: 54019 - DNA, 20 bp, Artificial Sequence
  sgRNA
  Slc16a4_18
cccatggtcacacaaagaaa

SEQ ID NO: 54020 - DNA, 20 bp, Artificial Sequence
  sgRNA
  Slc16a4_19
gatatgccagtttctttgcc

SEQ ID NO: 54021 - DNA, 20 bp, Artificial Sequence
  sgRNA
  Slc16a4_20
tacaccaaaccccttgatgg

SEQ ID NO: 54022 - DNA, 20 bp, Artificial Sequence
  sgRNA
  Slc16a5_1
gccgtacgctatgcatcatg

SEQ ID NO: 54023 - DNA, 20 bp, Artificial Sequence
  sgRNA
  Slc16a5_2
aggctccacatacacaacag

SEQ ID NO: 54024 - DNA, 20 bp, Artificial Sequence
  sgRNA
  Slc16a5_3
ggcttctgcatatacgtcac

SEQ ID NO: 54025 - DNA, 20 bp, Artificial Sequence
  sgRNA
  Slc16a5_4
ctgtgatcactcctgcggtg

SEQ ID NO: 54026 - DNA, 20 bp, Artificial Sequence
  sgRNA
  Slc16a5_5
gccaagagccctactccacg

SEQ ID NO: 54027 - DNA, 20 bp, Artificial Sequence
  sgRNA
  Slc16a5_6
gctcaccaatctaatatgca

SEQ ID NO: 54028 - DNA, 20 bp, Artificial Sequence
  sgRNA
  Slc16a5_7
gctgtggcgatcctcatcaa

SEQ ID NO: 54029 - DNA, 20 bp, Artificial Sequence
  sgRNA
  Slc16a5_8
ggtgagggcctgcgtcacca

SEQ ID NO: 54030 - DNA, 20 bp, Artificial Sequence
  sgRNA
  Slc16a5_9
tatacgtcacgggcgtgacg

SEQ ID NO: 54031 - DNA, 20 bp, Artificial Sequence
  sgRNA
  Slc16a5_10
agcaaacaggtacttccggt

SEQ ID NO: 54032 - DNA, 20 bp, Artificial Sequence
  sgRNA
  Slc16a5_11
accccatgatgcatagcgta

SEQ ID NO: 54033 - DNA, 20 bp, Artificial Sequence
  sgRNA
  Slc16a5_12
tatgtggcagtgcaaaaccc

SEQ ID NO: 54034 - DNA, 20 bp, Artificial Sequence
  sgRNA
  Slc16a5_13
ggcgtgacgtggatgaacct

SEQ ID NO: 54035 - DNA, 20 bp, Artificial Sequence
  sgRNA
  Slc16a5_14
ggacaatgtccattagaacc

SEQ ID NO: 54036 - DNA, 20 bp, Artificial Sequence
  sgRNA
  Slc16a5_15
ccagcaacagtgagacctcg

SEQ ID NO: 54037 - DNA, 20 bp, Artificial Sequence
  sgRNA
  Slc16a5_16
ggataagagagcctgagacg

SEQ ID NO: 54038 - DNA, 20 bp, Artificial Sequence
  sgRNA
  Slc16a5_17
gatgttgcagaagccaacaa

SEQ ID NO: 54039 - DNA, 20 bp, Artificial Sequence
  sgRNA
  Slc16a5_18
tgtacaccaggcaatagccc

SEQ ID NO: 54040 - DNA, 20 bp, Artificial Sequence
  sgRNA
  Slc16a5_19
ggaagagcttggctgcctac

SEQ ID NO: 54041 - DNA, 20 bp, Artificial Sequence
  sgRNA
  Slc16a5_20
cgagtgaccatgatgctggg

SEQ ID NO: 54042 - DNA, 20 bp, Artificial Sequence
  sgRNA
  Slc16a6_1
gctgtcgacgatggccattg

SEQ ID NO: 54043 - DNA, 20 bp, Artificial Sequence
  sgRNA
  Slc16a6_2
acagaatggtcacagttggg

SEQ ID NO: 54044 - DNA, 20 bp, Artificial Sequence
  sgRNA
  Slc16a6_3
caattattatccaagggccg

SEQ ID NO: 54045 - DNA, 20 bp, Artificial Sequence
  sgRNA
  Slc16a6_4
tgagtcgatggagtctattg

SEQ ID NO: 54046 - DNA, 20 bp, Artificial Sequence
  sgRNA
  Slc16a6_5
aaggcgttcggtagtcaccg

SEQ ID NO: 54047 - DNA, 20 bp, Artificial Sequence
  sgRNA
  Slc16a6_6
ttgcgcggccccgatccacg

SEQ ID NO: 54048 - DNA, 20 bp, Artificial Sequence
  sgRNA
  Slc16a6_7
ctctcccgtagaagcgaccg

SEQ ID NO: 54049 - DNA, 20 bp, Artificial Sequence
  sgRNA
  Slc16a6_8
accacatgtacatctccata

SEQ ID NO: 54050 - DNA, 20 bp, Artificial Sequence
  sgRNA
  Slc16a6_9
gtactttgacaaaaggcgtt

SEQ ID NO: 54051 - DNA, 20 bp, Artificial Sequence
  sgRNA
  Slc16a6_10
agatacagcctcctcttcgt

SEQ ID NO: 54052 - DNA, 20 bp, Artificial Sequence
  sgRNA
  Slc16a6_11
gacggagaagtccaacagcg

SEQ ID NO: 54053 - DNA, 20 bp, Artificial Sequence
  sgRNA
  Slc16a6_12
cccggcccttggataataat

SEQ ID NO: 54054 - DNA, 20 bp, Artificial Sequence
  sgRNA
  Slc16a6_13
atgcctagactgatacccaa

SEQ ID NO: 54055 - DNA, 20 bp, Artificial Sequence
  sgRNA
  Slc16a6_14
acgtcatcctctgccaacat

SEQ ID NO: 54056 - DNA, 20 bp, Artificial Sequence
  sgRNA
  Slc16a6_15
gcagaaggcccacgaagagg

SEQ ID NO: 54057 - DNA, 20 bp, Artificial Sequence
  sgRNA
  Slc16a6_16
gtcaaagtactgcgacagaa

SEQ ID NO: 54058 - DNA, 20 bp, Artificial Sequence
  sgRNA
  Slc16a6_17
gtaacgccttcccacgctgc

SEQ ID NO: 54059 - DNA, 20 bp, Artificial Sequence
  sgRNA
  Slc16a6_18
tcgacagcaaaaacgcagcg

SEQ ID NO: 54060 - DNA, 20 bp, Artificial Sequence
  sgRNA
  Slc16a6_19
tcttcattcagagcatctcg

SEQ ID NO: 54061 - DNA, 20 bp, Artificial Sequence
  sgRNA
  Slc16a6_20
tgctccatcttcgcttcgct

SEQ ID NO: 54062 - DNA, 20 bp, Artificial Sequence
  sgRNA
  Slc16a7_1
attacctccaatgaagccaa

SEQ ID NO: 54063 - DNA, 20 bp, Artificial Sequence
  sgRNA
  Slc16a7_2
agaggtactggattcgtgga

SEQ ID NO: 54064 - DNA, 20 bp, Artificial Sequence
  sgRNA
  Slc16a7_3
gctcagtacgctaaacacat

SEQ ID NO: 54065 - DNA, 20 bp, Artificial Sequence
  sgRNA
  Slc16a7_4
ttcaccaacacactactgat

SEQ ID NO: 54066 - DNA, 20 bp, Artificial Sequence
  sgRNA
  Slc16a7_5
ccacaaccacttcctcccga

SEQ ID NO: 54067 - DNA, 20 bp, Artificial Sequence
  sgRNA
  Slc16a7_6
ctagctgtcatgtatgcggg

SEQ ID NO: 54068 - DNA, 20 bp, Artificial Sequence
  sgRNA
  Slc16a7_7
aaccacttcctcccgacgga

SEQ ID NO: 54069 - DNA, 20 bp, Artificial Sequence
  sgRNA
  Slc16a7_8
ttatagcattgccaatcagg

SEQ ID NO: 54070 - DNA, 20 bp, Artificial Sequence
  sgRNA
  Slc16a7_9
agaagacgaccacttgcaaa

SEQ ID NO: 54071 - DNA, 20 bp, Artificial Sequence
  sgRNA
  Slc16a7_10
atagacttctcgacaaggaa

SEQ ID NO: 54072 - DNA, 20 bp, Artificial Sequence
  sgRNA
  Slc16a7_11
aaatacctgtacatagccag

SEQ ID NO: 54073 - DNA, 20 bp, Artificial Sequence
  sgRNA
  Slc16a7_12
tgtgggactcacaacaatcg

SEQ ID NO: 54074 - DNA, 20 bp, Artificial Sequence
  sgRNA
  Slc16a7_13
agtgtgttggtgaataacta

SEQ ID NO: 54075 - DNA, 20 bp, Artificial Sequence
  sgRNA
  Slc16a7_14
tggacattgttggagctacc

SEQ ID NO: 54076 - DNA, 20 bp, Artificial Sequence
  sgRNA
  Slc16a7_15
ggaacagtcgtgttagtatc

SEQ ID NO: 54077 - DNA, 20 bp, Artificial Sequence
  sgRNA
  Slc16a7_16
ccacctccagtcagatcgct

SEQ ID NO: 54078 - DNA, 20 bp, Artificial Sequence
  sgRNA
  Slc16a7_17
acctatttaacaactatggc

SEQ ID NO: 54079 - DNA, 20 bp, Artificial Sequence
  sgRNA
  Slc16a7_18
tatccaagcgatctgactgg

SEQ ID NO: 54080 - DNA, 20 bp, Artificial Sequence
  sgRNA
  Slc16a7_19
atacatgacagctagcatga

SEQ ID NO: 54081 - DNA, 20 bp, Artificial Sequence
  sgRNA
  Slc16a7_20
aagtggttgtggaagcggcg

SEQ ID NO: 54082 - DNA, 20 bp, Artificial Sequence
  sgRNA
  Slc16a8_1
agagacccctcgccccacgg

SEQ ID NO: 54083 - DNA, 20 bp, Artificial Sequence
  sgRNA
  Slc16a8_2
gacagccaaagcgcgtcacg

SEQ ID NO: 54084 - DNA, 20 bp, Artificial Sequence
  sgRNA
  Slc16a8_3
cctgctggtgaactacgcca

SEQ ID NO: 54085 - DNA, 20 bp, Artificial Sequence
  sgRNA
  Slc16a8_4
gaaagcaacgagggtcccgt

SEQ ID NO: 54086 - DNA, 20 bp, Artificial Sequence
  sgRNA
  Slc16a8_5
gtacaccacgaaagcacggt

SEQ ID NO: 54087 - DNA, 20 bp, Artificial Sequence
  sgRNA
  Slc16a8_6
gcactaggcccaatgcacta

SEQ ID NO: 54088 - DNA, 20 bp, Artificial Sequence
  sgRNA
  Slc16a8_7
gtacagctccacgaggcgcg

SEQ ID NO: 54089 - DNA, 20 bp, Artificial Sequence
  sgRNA
  Slc16a8_8
agttcttcagagcatccacc

SEQ ID NO: 54090 - DNA, 20 bp, Artificial Sequence
  sgRNA
  Slc16a8_9
ggtgaactacgccaaggacg

SEQ ID NO: 54091 - DNA, 20 bp, Artificial Sequence
  sgRNA
  Slc16a8_10
agccccagccaccatccgga

SEQ ID NO: 54092 - DNA, 20 bp, Artificial Sequence
  sgRNA
  Slc16a8_11
ggcaatgcagaaagcaacga

SEQ ID NO: 54093 - DNA, 20 bp, Artificial Sequence
  sgRNA
  Slc16a8_12
ccgtcaggtacagctccacg

SEQ ID NO: 54094 - DNA, 20 bp, Artificial Sequence
  sgRNA
  Slc16a8_13
agaagacgctcacagcctta

SEQ ID NO: 54095 - DNA, 20 bp, Artificial Sequence
  sgRNA
  Slc16a8_14
cctcgtggagctgtacctga

SEQ ID NO: 54096 - DNA, 20 bp, Artificial Sequence
  sgRNA
  Slc16a8_15
gaggtgctcatggcaaccgt

SEQ ID NO: 54097 - DNA, 20 bp, Artificial Sequence
  sgRNA
  Slc16a8_16
gctgcactgttgcgcctgtg

SEQ ID NO: 54098 - DNA, 20 bp, Artificial Sequence
  sgRNA
  Slc16a8_17
gtccaccagccagcatcacg

SEQ ID NO: 54099 - DNA, 20 bp, Artificial Sequence
  sgRNA
  Slc16a8_18
ggaagttgagagctaggccc

SEQ ID NO: 54100 - DNA, 20 bp, Artificial Sequence
  sgRNA
  Slc16a8_19
ccacgtacaccacgaaagca

SEQ ID NO: 54101 - DNA, 20 bp, Artificial Sequence
  sgRNA
  Slc16a8_20
gactctacttcgagcggcga

SEQ ID NO: 54102 - DNA, 20 bp, Artificial Sequence
  sgRNA
  Slc17a1_1
acagattcgttagataaatg

SEQ ID NO: 54103 - DNA, 20 bp, Artificial Sequence
  sgRNA
  Slc17a1_2
attgtgtgtcgagtactcca

SEQ ID NO: 54104 - DNA, 20 bp, Artificial Sequence
  sgRNA
  Slc17a1_3
tgggcacctcccttagaacg

SEQ ID NO: 54105 - DNA, 20 bp, Artificial Sequence
  sgRNA
  Slc17a1_4
atgtcggcgtgtatgtaacc

SEQ ID NO: 54106 - DNA, 20 bp, Artificial Sequence
  sgRNA
  Slc17a1_5
gatagccagtccataccgga

SEQ ID NO: 54107 - DNA, 20 bp, Artificial Sequence
  sgRNA
  Slc17a1_6
agtgtgcctgaacctcacca

SEQ ID NO: 54108 - DNA, 20 bp, Artificial Sequence
  sgRNA
  Slc17a1_7
cactgctgctcatatacggg

SEQ ID NO: 54109 - DNA, 20 bp, Artificial Sequence
  sgRNA
  Slc17a1_8
tgtggtgaagagtttccgga

SEQ ID NO: 54110 - DNA, 20 bp, Artificial Sequence
  sgRNA
  Slc17a1_9
gtaagtctgcctcgttctaa

SEQ ID NO: 54111 - DNA, 20 bp, Artificial Sequence
  sgRNA
  Slc17a1_10
gcaaggacatcaaagagctg

SEQ ID NO: 54112 - DNA, 20 bp, Artificial Sequence
  sgRNA
  Slc17a1_11
taccggaaggaacagaaccc

SEQ ID NO: 54113 - DNA, 20 bp, Artificial Sequence
  sgRNA
  Slc17a1_12
catatggtcgaacagtctcc

SEQ ID NO: 54114 - DNA, 20 bp, Artificial Sequence
  sgRNA
  Slc17a1_13
ccaaagatgtagaagaccat

SEQ ID NO: 54115 - DNA, 20 bp, Artificial Sequence
  sgRNA
  Slc17a1_14
agtactccagggaatagccc

SEQ ID NO: 54116 - DNA, 20 bp, Artificial Sequence
  sgRNA
  Slc17a1_15
attccagataggtacccgac

SEQ ID NO: 54117 - DNA, 20 bp, Artificial Sequence
  sgRNA
  Slc17a1_16
tttattgtcctgcttgtgag

SEQ ID NO: 54118 - DNA, 20 bp, Artificial Sequence
  sgRNA
  Slc17a1_17
tcatatacgggtggtccttg

SEQ ID NO: 54119 - DNA, 20 bp, Artificial Sequence
  sgRNA
  Slc17a1_18
tgaccctgtgttgttcacca

SEQ ID NO: 54120 - DNA, 20 bp, Artificial Sequence
  sgRNA
  Slc17a1_19
tctcactgctgctcatatac

SEQ ID NO: 54121 - DNA, 20 bp, Artificial Sequence
  sgRNA
  Slc17a1_20
gttgttcaccatggctacca

SEQ ID NO: 54122 - DNA, 20 bp, Artificial Sequence
  sgRNA
  Slc17a5_1
tcgtcacccagattcccggt

SEQ ID NO: 54123 - DNA, 20 bp, Artificial Sequence
  sgRNA
  Slc17a5_2
tagaacgtctaaggagtgtg

SEQ ID NO: 54124 - DNA, 20 bp, Artificial Sequence
  sgRNA
  Slc17a5_3
gatcgttatcttacccgcat

SEQ ID NO: 54125 - DNA, 20 bp, Artificial Sequence
  sgRNA
  Slc17a5_4
gctggccgcagacttaggcg

SEQ ID NO: 54126 - DNA, 20 bp, Artificial Sequence
  sgRNA
  Slc17a5_5
ccgcgactaggaaaaccgca

SEQ ID NO: 54127 - DNA, 20 bp, Artificial Sequence
  sgRNA
  Slc17a5_6
tcctcatcgtcgtttcccgc

SEQ ID NO: 54128 - DNA, 20 bp, Artificial Sequence
  sgRNA
  Slc17a5_7
gacttcaagatggaccccca

SEQ ID NO: 54129 - DNA, 20 bp, Artificial Sequence
  sgRNA
  Slc17a5_8
tgtccactaacgcaacactc

SEQ ID NO: 54130 - DNA, 20 bp, Artificial Sequence
  sgRNA
  Slc17a5_9
gctaccacaattgcccaaag

SEQ ID NO: 54131 - DNA, 20 bp, Artificial Sequence
  sgRNA
  Slc17a5_10
ctataaatccagccgcgact

SEQ ID NO: 54132 - DNA, 20 bp, Artificial Sequence
  sgRNA
  Slc17a5_11
ggatatggttaggaacgcaa

SEQ ID NO: 54133 - DNA, 20 bp, Artificial Sequence
  sgRNA
  Slc17a5_12
acgaaggagcgatatccaga

SEQ ID NO: 54134 - DNA, 20 bp, Artificial Sequence
  sgRNA
  Slc17a5_13
acattgccagcagggtcgga

SEQ ID NO: 54135 - DNA, 20 bp, Artificial Sequence
  sgRNA
  Slc17a5_14
cttgacccttaaatagtcag

SEQ ID NO: 54136 - DNA, 20 bp, Artificial Sequence
  sgRNA
  Slc17a5_15
acacgtttgccactattccc

SEQ ID NO: 54137 - DNA, 20 bp, Artificial Sequence
  sgRNA
  Slc17a5_16
tcaagccgctgactatttaa

SEQ ID NO: 54138 - DNA, 20 bp, Artificial Sequence
  sgRNA
  Slc17a5_17
accatatccacgacgctggg

SEQ ID NO: 54139 - DNA, 20 bp, Artificial Sequence
  sgRNA
  Slc17a5_18
atcgtcacccagattcccgg

SEQ ID NO: 54140 - DNA, 20 bp, Artificial Sequence
  sgRNA
  Slc17a5_19
ctaaccatatccacgacgct

SEQ ID NO: 54141 - DNA, 20 bp, Artificial Sequence
  sgRNA
  Slc17a5_20
gccgcgactaggaaaaccgc

SEQ ID NO: 54142 - DNA, 20 bp, Artificial Sequence
  sgRNA
  Slc17a6_1
caggaggatatatcgcatcg

SEQ ID NO: 54143 - DNA, 20 bp, Artificial Sequence
  sgRNA
  Slc17a6_2
agaaatttaagaccccatgg

SEQ ID NO: 54144 - DNA, 20 bp, Artificial Sequence
  sgRNA
  Slc17a6_3
aagcacgtgcagtcgcatag

SEQ ID NO: 54145 - DNA, 20 bp, Artificial Sequence
  sgRNA
  Slc17a6_4
aacaacagcactatccaccg

SEQ ID NO: 54146 - DNA, 20 bp, Artificial Sequence
  sgRNA
  Slc17a6_5
cgatccgtggatcatcccca

SEQ ID NO: 54147 - DNA, 20 bp, Artificial Sequence
  sgRNA
  Slc17a6_6
atggctatgatgtagcggcg

SEQ ID NO: 54148 - DNA, 20 bp, Artificial Sequence
  sgRNA
  Slc17a6_7
caatcattgtgcctatcggg

SEQ ID NO: 54149 - DNA, 20 bp, Artificial Sequence
  sgRNA
  Slc17a6_8
gagaccgtggggatgatcca

SEQ ID NO: 54150 - DNA, 20 bp, Artificial Sequence
  sgRNA
  Slc17a6_9
agccccagaagaacgatccg

SEQ ID NO: 54151 - DNA, 20 bp, Artificial Sequence
  sgRNA
  Slc17a6_10
tggctactctcatactagag

SEQ ID NO: 54152 - DNA, 20 bp, Artificial Sequence
  sgRNA
  Slc17a6_11
tgataactttgcctccgcgg

SEQ ID NO: 54153 - DNA, 20 bp, Artificial Sequence
  sgRNA
  Slc17a6_12
gctacctcacaggagaatgg

SEQ ID NO: 54154 - DNA, 20 bp, Artificial Sequence
  sgRNA
  Slc17a6_13
ccattacagatgaagaacgt

SEQ ID NO: 54155 - DNA, 20 bp, Artificial Sequence
  sgRNA
  Slc17a6_14
ctatgcgactgcacgtgctt

SEQ ID NO: 54156 - DNA, 20 bp, Artificial Sequence
  sgRNA
  Slc17a6_15
ataatcatctcggtccttat

SEQ ID NO: 54157 - DNA, 20 bp, Artificial Sequence
  sgRNA
  Slc17a6_16
tgaagaacgtaggtacatag

SEQ ID NO: 54158 - DNA, 20 bp, Artificial Sequence
  sgRNA
  Slc17a6_17
actgggaccccgagaccgtg

SEQ ID NO: 54159 - DNA, 20 bp, Artificial Sequence
  sgRNA
  Slc17a6_18
gccaacctactcctctccaa

SEQ ID NO: 54160 - DNA, 20 bp, Artificial Sequence
  sgRNA
  Slc17a6_19
tctgcaatttgccccccgat

SEQ ID NO: 54161 - DNA, 20 bp, Artificial Sequence
  sgRNA
  Slc17a6_20
ggatcatccccacggtctcg

SEQ ID NO: 54162 - DNA, 20 bp, Artificial Sequence
  sgRNA
  Slc17a7_1
tggcgatgatgtagcgacga

SEQ ID NO: 54163 - DNA, 20 bp, Artificial Sequence
  sgRNA
  Slc17a7_2
ggaggagcgcaaatacattg

SEQ ID NO: 54164 - DNA, 20 bp, Artificial Sequence
  sgRNA
  Slc17a7_3
gacacagccatagtgaacgc

SEQ ID NO: 54165 - DNA, 20 bp, Artificial Sequence
  sgRNA
  Slc17a7_4
tccatcctgaatactgcaca

SEQ ID NO: 54166 - DNA, 20 bp, Artificial Sequence
  sgRNA
  Slc17a7_5
gcctccctggtgcactacgg

SEQ ID NO: 54167 - DNA, 20 bp, Artificial Sequence
  sgRNA
  Slc17a7_6
tcagcgatctggcctccaat

SEQ ID NO: 54168 - DNA, 20 bp, Artificial Sequence
  sgRNA
  Slc17a7_7
atagcctccctggtgcacta

SEQ ID NO: 54169 - DNA, 20 bp, Artificial Sequence
  sgRNA
  Slc17a7_8
gacaccgccgtagtgcacca

SEQ ID NO: 54170 - DNA, 20 bp, Artificial Sequence
  sgRNA
  Slc17a7_9
gttcatgagctttcgcacgt

SEQ ID NO: 54171 - DNA, 20 bp, Artificial Sequence
  sgRNA
  Slc17a7_10
gcgaaagctcatgaactgcg

SEQ ID NO: 54172 - DNA, 20 bp, Artificial Sequence
  sgRNA
  Slc17a7_11
atactcgcactccaagggcg

SEQ ID NO: 54173 - DNA, 20 bp, Artificial Sequence
  sgRNA
  Slc17a7_12
tggagctgagtgccgacggg

SEQ ID NO: 54174 - DNA, 20 bp, Artificial Sequence
  sgRNA
  Slc17a7_13
gctttgagatcagcaaggtg

SEQ ID NO: 54175 - DNA, 20 bp, Artificial Sequence
  sgRNA
  Slc17a7_14
gagactgtcggcctcataca

SEQ ID NO: 54176 - DNA, 20 bp, Artificial Sequence
  sgRNA
  Slc17a7_15
gcttccgaaactcctcctgc

SEQ ID NO: 54177 - DNA, 20 bp, Artificial Sequence
  sgRNA
  Slc17a7_16
cgaaagctcatgaactgcgg

SEQ ID NO: 54178 - DNA, 20 bp, Artificial Sequence
  sgRNA
  Slc17a7_17
atacaggtctgtccacaaac

SEQ ID NO: 54179 - DNA, 20 bp, Artificial Sequence
  sgRNA
  Slc17a7_18
tcaagatgctggcatagcga

SEQ ID NO: 54180 - DNA, 20 bp, Artificial Sequence
  sgRNA
  Slc17a7_19
aatgggcccctcccttagaa

SEQ ID NO: 54181 - DNA, 20 bp, Artificial Sequence
  sgRNA
  Slc17a7_20
caggtctgtccacaaacagg

SEQ ID NO: 54182 - DNA, 20 bp, Artificial Sequence
  sgRNA
  Slc17a8_1
cagcaatgatgtaccgtttg

SEQ ID NO: 54183 - DNA, 20 bp, Artificial Sequence
  sgRNA
  Slc17a8_2
aatgatggcatagacaggca

SEQ ID NO: 54184 - DNA, 20 bp, Artificial Sequence
  sgRNA
  Slc17a8_3
actcgctgggcatcttacaa

SEQ ID NO: 54185 - DNA, 20 bp, Artificial Sequence
  sgRNA
  Slc17a8_4
tcagccagttgtcctccgat

SEQ ID NO: 54186 - DNA, 20 bp, Artificial Sequence
  sgRNA
  Slc17a8_5
gagagaatctgccttcgacg

SEQ ID NO: 54187 - DNA, 20 bp, Artificial Sequence
  sgRNA
  Slc17a8_6
aatgcaccctcgccgcagaa

SEQ ID NO: 54188 - DNA, 20 bp, Artificial Sequence
  sgRNA
  Slc17a8_7
gcagtcacagatgtaccgct

SEQ ID NO: 54189 - DNA, 20 bp, Artificial Sequence
  sgRNA
  Slc17a8_8
cagcggagtcatcttctacg

SEQ ID NO: 54190 - DNA, 20 bp, Artificial Sequence
  sgRNA
  Slc17a8_9
gcagcgctggtacactacag

SEQ ID NO: 54191 - DNA, 20 bp, Artificial Sequence
  sgRNA
  Slc17a8_10
aaggttgcaccgaatcccaa

SEQ ID NO: 54192 - DNA, 20 bp, Artificial Sequence
  sgRNA
  Slc17a8_11
attgtgacacaaattcccgg

SEQ ID NO: 54193 - DNA, 20 bp, Artificial Sequence
  sgRNA
  Slc17a8_12
acacatggtgatgacaatcg

SEQ ID NO: 54194 - DNA, 20 bp, Artificial Sequence
  sgRNA
  Slc17a8_13
tttccacaatggccactcca

SEQ ID NO: 54195 - DNA, 20 bp, Artificial Sequence
  sgRNA
  Slc17a8_14
tgggacttacgaaagtctcg

SEQ ID NO: 54196 - DNA, 20 bp, Artificial Sequence
  sgRNA
  Slc17a8_15
caccatttgagatccccatg

SEQ ID NO: 54197 - DNA, 20 bp, Artificial Sequence
  sgRNA
  Slc17a8_16
tgacccagagaatctctctg

SEQ ID NO: 54198 - DNA, 20 bp, Artificial Sequence
  sgRNA
  Slc17a8_17
tctgcggcgagggtgcatta

SEQ ID NO: 54199 - DNA, 20 bp, Artificial Sequence
  sgRNA
  Slc17a8_18
atattgttgggtgagctgcc

SEQ ID NO: 54200 - DNA, 20 bp, Artificial Sequence
  sgRNA
  Slc17a8_19
gatgtgaaaaaccttctcca

SEQ ID NO: 54201 - DNA, 20 bp, Artificial Sequence
  sgRNA
  Slc17a8_20
tgtttatcccttctgcggcg

SEQ ID NO: 54202 - DNA, 20 bp, Artificial Sequence
  sgRNA
  Slc17a9_1
gattcgagagaatgtcagga

SEQ ID NO: 54203 - DNA, 20 bp, Artificial Sequence
  sgRNA
  Slc17a9_2
ggcaacagtacagacgggca

SEQ ID NO: 54204 - DNA, 20 bp, Artificial Sequence
  sgRNA
  Slc17a9_3
ttggttaccgatccccaagg

SEQ ID NO: 54205 - DNA, 20 bp, Artificial Sequence
  sgRNA
  Slc17a9_4
tctgggcgtactatgtgtac

SEQ ID NO: 54206 - DNA, 20 bp, Artificial Sequence
  sgRNA
  Slc17a9_5
acaccactgcttgcgcacct

SEQ ID NO: 54207 - DNA, 20 bp, Artificial Sequence
  sgRNA
  Slc17a9_6
gcctacgcccccagtcacca

SEQ ID NO: 54208 - DNA, 20 bp, Artificial Sequence
  sgRNA
  Slc17a9_7
acattctctcgaatcctcac

SEQ ID NO: 54209 - DNA, 20 bp, Artificial Sequence
  sgRNA
  Slc17a9_8
gccttgagcaaggaatccca

SEQ ID NO: 54210 - DNA, 20 bp, Artificial Sequence
  sgRNA
  Slc17a9_9
gtagccatcatcagcaacct

SEQ ID NO: 54211 - DNA, 20 bp, Artificial Sequence
  sgRNA
  Slc17a9_10
tagccatcatcagcaacctg

SEQ ID NO: 54212 - DNA, 20 bp, Artificial Sequence
  sgRNA
  Slc17a9_11
tcttgctgtcagcctccgcc

SEQ ID NO: 54213 - DNA, 20 bp, Artificial Sequence
  sgRNA
  Slc17a9_12
atgcaaagatcatagccttg

SEQ ID NO: 54214 - DNA, 20 bp, Artificial Sequence
  sgRNA
  Slc17a9_13
ttcctgctagtctattcagt

SEQ ID NO: 54215 - DNA, 20 bp, Artificial Sequence
  sgRNA
  Slc17a9_14
ctgcttgcgcacctcggcag

SEQ ID NO: 54216 - DNA, 20 bp, Artificial Sequence
  sgRNA
  Slc17a9_15
gggtcttcaatgtagtcccc

SEQ ID NO: 54217 - DNA, 20 bp, Artificial Sequence
  sgRNA
  Slc17a9_16
tcacaggtaggccttgagca

SEQ ID NO: 54218 - DNA, 20 bp, Artificial Sequence
  sgRNA
  Slc17a9_17
gctgcatcaggctagagcgc

SEQ ID NO: 54219 - DNA, 20 bp, Artificial Sequence
  sgRNA
  Slc17a9_18
tggtgttcgggaaggcgcag

SEQ ID NO: 54220 - DNA, 20 bp, Artificial Sequence
  sgRNA
  Slc17a9_19
gacccgcaagaccccttctg

SEQ ID NO: 54221 - DNA, 20 bp, Artificial Sequence
  sgRNA
  Slc17a9_20
tatcctctgctgccgcagaa

SEQ ID NO: 54222 - DNA, 20 bp, Artificial Sequence
  sgRNA
  Slc18a1_1
ggacaatatgctgctcactg

SEQ ID NO: 54223 - DNA, 20 bp, Artificial Sequence
  sgRNA
  Slc18a1_2
gtagttatccgtatagacac

SEQ ID NO: 54224 - DNA, 20 bp, Artificial Sequence
  sgRNA
  Slc18a1_3
tcataaagccaacaaacatg

SEQ ID NO: 54225 - DNA, 20 bp, Artificial Sequence
  sgRNA
  Slc18a1_4
ctaaaaacaactgcttgcaa

SEQ ID NO: 54226 - DNA, 20 bp, Artificial Sequence
  sgRNA
  Slc18a1_5
tcatacatcacacttccaaa

SEQ ID NO: 54227 - DNA, 20 bp, Artificial Sequence
  sgRNA
  Slc18a1_6
tcatcgctgttctctcccag

SEQ ID NO: 54228 - DNA, 20 bp, Artificial Sequence
  sgRNA
  Slc18a1_7
tgtcaaaagtggagtcccca

SEQ ID NO: 54229 - DNA, 20 bp, Artificial Sequence
  sgRNA
  Slc18a1_8
aggtatggcgtaagtccacc

SEQ ID NO: 54230 - DNA, 20 bp, Artificial Sequence
  sgRNA
  Slc18a1_9
tgttggccaacacaccaaaa

SEQ ID NO: 54231 - DNA, 20 bp, Artificial Sequence
  sgRNA
  Slc18a1_10
cccacgaaggagtttccact

SEQ ID NO: 54232 - DNA, 20 bp, Artificial Sequence
  sgRNA
  Slc18a1_11
acaaaaagccacatcagcga

SEQ ID NO: 54233 - DNA, 20 bp, Artificial Sequence
  sgRNA
  Slc18a1_12
ggtgtgttggccaacaagat

SEQ ID NO: 54234 - DNA, 20 bp, Artificial Sequence
  sgRNA
  Slc18a1_13
gagccagcttcggtgactgg

SEQ ID NO: 54235 - DNA, 20 bp, Artificial Sequence
  sgRNA
  Slc18a1_14
ccttccttcagcagtcgctg

SEQ ID NO: 54236 - DNA, 20 bp, Artificial Sequence
  sgRNA
  Slc18a1_15
atagacactcccatacacag

SEQ ID NO: 54237 - DNA, 20 bp, Artificial Sequence
  sgRNA
  Slc18a1_16
gatgctggccagtgtctata

SEQ ID NO: 54238 - DNA, 20 bp, Artificial Sequence
  sgRNA
  Slc18a1_17
catcatccagatgggtagcg

SEQ ID NO: 54239 - DNA, 20 bp, Artificial Sequence
  sgRNA
  Slc18a1_18
ccaaaaatattgtgagccag

SEQ ID NO: 54240 - DNA, 20 bp, Artificial Sequence
  sgRNA
  Slc18a1_19
gcagtcccggaagctggtgt

SEQ ID NO: 54241 - DNA, 20 bp, Artificial Sequence
  sgRNA
  Slc18a1_20
gcaaagccaaggcctgcatt

SEQ ID NO: 54242 - DNA, 20 bp, Artificial Sequence
  sgRNA
  Slc18a2_1
cgagccatacgtacctacga

SEQ ID NO: 54243 - DNA, 20 bp, Artificial Sequence
  sgRNA
  Slc18a2_2
ccatctgctttgcaaacatg

SEQ ID NO: 54244 - DNA, 20 bp, Artificial Sequence
  sgRNA
  Slc18a2_3
gtacatacctaagaccccca

SEQ ID NO: 54245 - DNA, 20 bp, Artificial Sequence
  sgRNA
  Slc18a2_4
atgcagaatccagcaaacat

SEQ ID NO: 54246 - DNA, 20 bp, Artificial Sequence
  sgRNA
  Slc18a2_5
ggatcagcttgcgcgagtgg

SEQ ID NO: 54247 - DNA, 20 bp, Artificial Sequence
  sgRNA
  Slc18a2_6
gattcttcatcatcaccgac

SEQ ID NO: 54248 - DNA, 20 bp, Artificial Sequence
  sgRNA
  Slc18a2_7
tgttgtctagcagcagcgcg

SEQ ID NO: 54249 - DNA, 20 bp, Artificial Sequence
  sgRNA
  Slc18a2_8
taagcacgagaaaaatacta

SEQ ID NO: 54250 - DNA, 20 bp, Artificial Sequence
  sgRNA
  Slc18a2_9
gatagcataccccatgcaga

SEQ ID NO: 54251 - DNA, 20 bp, Artificial Sequence
  sgRNA
  Slc18a2_10
aatgtccagccgtaccccgt

SEQ ID NO: 54252 - DNA, 20 bp, Artificial Sequence
  sgRNA
  Slc18a2_11
gcgagcatctcttatctcat

SEQ ID NO: 54253 - DNA, 20 bp, Artificial Sequence
  sgRNA
  Slc18a2_12
gccccccagagcaatcccca

SEQ ID NO: 54254 - DNA, 20 bp, Artificial Sequence
  sgRNA
  Slc18a2_13
tgttcacggggaatgccacg

SEQ ID NO: 54255 - DNA, 20 bp, Artificial Sequence
  sgRNA
  Slc18a2_14
tcatagagcacacttccaaa

SEQ ID NO: 54256 - DNA, 20 bp, Artificial Sequence
  sgRNA
  Slc18a2_15
gcagaaggctacatctgcaa

SEQ ID NO: 54257 - DNA, 20 bp, Artificial Sequence
  sgRNA
  Slc18a2_16
agattcttcatcatcaccga

SEQ ID NO: 54258 - DNA, 20 bp, Artificial Sequence
  sgRNA
  Slc18a2_17
gcaatagcaccaccagcaga

SEQ ID NO: 54259 - DNA, 20 bp, Artificial Sequence
  sgRNA
  Slc18a2_18
acaactctactgtgttcacg

SEQ ID NO: 54260 - DNA, 20 bp, Artificial Sequence
  sgRNA
  Slc18a2_19
atgagataagagatgctcgc

SEQ ID NO: 54261 - DNA, 20 bp, Artificial Sequence
  sgRNA
  Slc18a2_20
tcttcactggggcagtcggg

SEQ ID NO: 54262 - DNA, 20 bp, Artificial Sequence
  sgRNA
  Slc18a3_1
agatagacgcctaacacgtg

SEQ ID NO: 54263 - DNA, 20 bp, Artificial Sequence
  sgRNA
  Slc18a3_2
ggtcggctcggtcaatcctg

SEQ ID NO: 54264 - DNA, 20 bp, Artificial Sequence
  sgRNA
  Slc18a3_3
gcttgcccgcgaactcgtag

SEQ ID NO: 54265 - DNA, 20 bp, Artificial Sequence
  sgRNA
  Slc18a3_4
ctatatcgctcacatgcgcg

SEQ ID NO: 54266 - DNA, 20 bp, Artificial Sequence
  sgRNA
  Slc18a3_5
atagcgcgccgctagacgca

SEQ ID NO: 54267 - DNA, 20 bp, Artificial Sequence
  sgRNA
  Slc18a3_6
gatcgccgacaagtatcccg

SEQ ID NO: 54268 - DNA, 20 bp, Artificial Sequence
  sgRNA
  Slc18a3_7
cattgtgtgcttcatccacg

SEQ ID NO: 54269 - DNA, 20 bp, Artificial Sequence
  sgRNA
  Slc18a3_8
gcgtcgtacagaccctgcgg

SEQ ID NO: 54270 - DNA, 20 bp, Artificial Sequence
  sgRNA
  Slc18a3_9
tccaccagaaaggcgagcgt

SEQ ID NO: 54271 - DNA, 20 bp, Artificial Sequence
  sgRNA
  Slc18a3_10
ccaacgcgatgccgaagcag

SEQ ID NO: 54272 - DNA, 20 bp, Artificial Sequence
  sgRNA
  Slc18a3_11
ctgcttgatgaaccgccgca

SEQ ID NO: 54273 - DNA, 20 bp, Artificial Sequence
  sgRNA
  Slc18a3_12
gactatatcgctcacatgcg

SEQ ID NO: 54274 - DNA, 20 bp, Artificial Sequence
  sgRNA
  Slc18a3_13
actgcgcgcagcgaagagcg

SEQ ID NO: 54275 - DNA, 20 bp, Artificial Sequence
  sgRNA
  Slc18a3_14
gcgcatgtgagcgatatagt

SEQ ID NO: 54276 - DNA, 20 bp, Artificial Sequence
  sgRNA
  Slc18a3_15
cactgccatagactgatacg

SEQ ID NO: 54277 - DNA, 20 bp, Artificial Sequence
  sgRNA
  Slc18a3_16
aggctcctcgggatacttgt

SEQ ID NO: 54278 - DNA, 20 bp, Artificial Sequence
  sgRNA
  Slc18a3_17
cgacgcactcctactcctgg

SEQ ID NO: 54279 - DNA, 20 bp, Artificial Sequence
  sgRNA
  Slc18a3_18
tatatcgctcacatgcgcgg

SEQ ID NO: 54280 - DNA, 20 bp, Artificial Sequence
  sgRNA
  Slc18a3_19
tgcgtcgaagagcgacacgg

SEQ ID NO: 54281 - DNA, 20 bp, Artificial Sequence
  sgRNA
  Slc18a3_20
gtatggcgctctcgggctag

SEQ ID NO: 54282 - DNA, 20 bp, Artificial Sequence
  sgRNA
  Slc19a1_1
tctttctaaagcgccctaag

SEQ ID NO: 54283 - DNA, 20 bp, Artificial Sequence
  sgRNA
  Slc19a1_2
cctggaacgtaaattcacca

SEQ ID NO: 54284 - DNA, 20 bp, Artificial Sequence
  sgRNA
  Slc19a1_3
catggccagctactcacggg

SEQ ID NO: 54285 - DNA, 20 bp, Artificial Sequence
  sgRNA
  Slc19a1_4
ccggtgcatactcagcagtg

SEQ ID NO: 54286 - DNA, 20 bp, Artificial Sequence
  sgRNA
  Slc19a1_5
tgtgcaagcgataagcctac

SEQ ID NO: 54287 - DNA, 20 bp, Artificial Sequence
  sgRNA
  Slc19a1_6
agtcttctacagcgtcacca

SEQ ID NO: 54288 - DNA, 20 bp, Artificial Sequence
  sgRNA
  Slc19a1_7
gccacactctgcatactcca

SEQ ID NO: 54289 - DNA, 20 bp, Artificial Sequence
  sgRNA
  Slc19a1_8
aaccgcagtacgcttgcgcg

SEQ ID NO: 54290 - DNA, 20 bp, Artificial Sequence
  sgRNA
  Slc19a1_9
gcttccctcccccaaagaca

SEQ ID NO: 54291 - DNA, 20 bp, Artificial Sequence
  sgRNA
  Slc19a1_10
cttgtggtctctgacaagcg

SEQ ID NO: 54292 - DNA, 20 bp, Artificial Sequence
  sgRNA
  Slc19a1_11
gtagcgggaggggtgcacca

SEQ ID NO: 54293 - DNA, 20 bp, Artificial Sequence
  sgRNA
  Slc19a1_12
gccatgcgctggtagcggga

SEQ ID NO: 54294 - DNA, 20 bp, Artificial Sequence
  sgRNA
  Slc19a1_13
tggtgaatttacgttccagg

SEQ ID NO: 54295 - DNA, 20 bp, Artificial Sequence
  sgRNA
  Slc19a1_14
cctacaggatggagacctaa

SEQ ID NO: 54296 - DNA, 20 bp, Artificial Sequence
  sgRNA
  Slc19a1_15
actgaaatcctggcgatgcc

SEQ ID NO: 54297 - DNA, 20 bp, Artificial Sequence
  sgRNA
  Slc19a1_16
gcgtctctggtgcctctggt

SEQ ID NO: 54298 - DNA, 20 bp, Artificial Sequence
  sgRNA
  Slc19a1_17
tggcttgtatcgcaggtagt

SEQ ID NO: 54299 - DNA, 20 bp, Artificial Sequence
  sgRNA
  Slc19a1_18
aggaaactagatcgcatgct

SEQ ID NO: 54300 - DNA, 20 bp, Artificial Sequence
  sgRNA
  Slc19a1_19
gcggatgctcaggaagccgg

SEQ ID NO: 54301 - DNA, 20 bp, Artificial Sequence
  sgRNA
  Slc19a1_20
ataggtgcttatatgtccta

SEQ ID NO: 54302 - DNA, 20 bp, Artificial Sequence
  sgRNA
  Slc19a2_1
ggagtagtaggcgatttcgg

SEQ ID NO: 54303 - DNA, 20 bp, Artificial Sequence
  sgRNA
  Slc19a2_2
gactcagcctgattgtgacg

SEQ ID NO: 54304 - DNA, 20 bp, Artificial Sequence
  sgRNA
  Slc19a2_3
caagtggtgaactacgcgca

SEQ ID NO: 54305 - DNA, 20 bp, Artificial Sequence
  sgRNA
  Slc19a2_4
gcaggaaccagcactcgcga

SEQ ID NO: 54306 - DNA, 20 bp, Artificial Sequence
  sgRNA
  Slc19a2_5
gagtggtgatacataagcca

SEQ ID NO: 54307 - DNA, 20 bp, Artificial Sequence
  sgRNA
  Slc19a2_6
ggtgttcacgccgaacacaa

SEQ ID NO: 54308 - DNA, 20 bp, Artificial Sequence
  sgRNA
  Slc19a2_7
ccaagtggtgaactacgcgc

SEQ ID NO: 54309 - DNA, 20 bp, Artificial Sequence
  sgRNA
  Slc19a2_8
ggtggacagggcccaccaca

SEQ ID NO: 54310 - DNA, 20 bp, Artificial Sequence
  sgRNA
  Slc19a2_9
tactgactatgccattcgcc

SEQ ID NO: 54311 - DNA, 20 bp, Artificial Sequence
  sgRNA
  Slc19a2_10
gcatgaaccacgtcacaatc

SEQ ID NO: 54312 - DNA, 20 bp, Artificial Sequence
  sgRNA
  Slc19a2_11
agttcttgtcgggtcccaga

SEQ ID NO: 54313 - DNA, 20 bp, Artificial Sequence
  sgRNA
  Slc19a2_12
aacggcctcaaggtacaaaa

SEQ ID NO: 54314 - DNA, 20 bp, Artificial Sequence
  sgRNA
  Slc19a2_13
ggcctcaaggtacaaaacgg

SEQ ID NO: 54315 - DNA, 20 bp, Artificial Sequence
  sgRNA
  Slc19a2_14
gaggctcatctaaatttaga

SEQ ID NO: 54316 - DNA, 20 bp, Artificial Sequence
  sgRNA
  Slc19a2_15
acggcttcttcgcaaacctc

SEQ ID NO: 54317 - DNA, 20 bp, Artificial Sequence
  sgRNA
  Slc19a2_16
gccgttcactccatgacagg

SEQ ID NO: 54318 - DNA, 20 bp, Artificial Sequence
  sgRNA
  Slc19a2_17
gattgctgcgaacctcagca

SEQ ID NO: 54319 - DNA, 20 bp, Artificial Sequence
  sgRNA
  Slc19a2_18
gctagtgctgtgtttgcagt

SEQ ID NO: 54320 - DNA, 20 bp, Artificial Sequence
  sgRNA
  Slc19a2_19
cctgcgcgtagttcaccact

SEQ ID NO: 54321 - DNA, 20 bp, Artificial Sequence
  sgRNA
  Slc19a2_20
aaatttagatgagcctccgg

SEQ ID NO: 54322 - DNA, 20 bp, Artificial Sequence
  sgRNA
  Slc19a3_1
ctgtcggagtatcacactgg

SEQ ID NO: 54323 - DNA, 20 bp, Artificial Sequence
  sgRNA
  Slc19a3_2
tgccaattcaaagaatctag

SEQ ID NO: 54324 - DNA, 20 bp, Artificial Sequence
  sgRNA
  Slc19a3_3
accagagggaccagtaaaca

SEQ ID NO: 54325 - DNA, 20 bp, Artificial Sequence
  sgRNA
  Slc19a3_4
acaacgtgtagcatgatgac

SEQ ID NO: 54326 - DNA, 20 bp, Artificial Sequence
  sgRNA
  Slc19a3_5
ctgctcagctaagtgccgaa

SEQ ID NO: 54327 - DNA, 20 bp, Artificial Sequence
  sgRNA
  Slc19a3_6
ggtgtctatgccgaacacca

SEQ ID NO: 54328 - DNA, 20 bp, Artificial Sequence
  sgRNA
  Slc19a3_7
gggctatctgaaggtcaact

SEQ ID NO: 54329 - DNA, 20 bp, Artificial Sequence
  sgRNA
  Slc19a3_8
tacagaaccttgctaccacc

SEQ ID NO: 54330 - DNA, 20 bp, Artificial Sequence
  sgRNA
  Slc19a3_9
tgtggcaaaagcccaccaga

SEQ ID NO: 54331 - DNA, 20 bp, Artificial Sequence
  sgRNA
  Slc19a3_10
gagcttagaacgttatgccc

SEQ ID NO: 54332 - DNA, 20 bp, Artificial Sequence
  sgRNA
  Slc19a3_11
ttacttcgctgtcattgcgg

SEQ ID NO: 54333 - DNA, 20 bp, Artificial Sequence
  sgRNA
  Slc19a3_12
tggctcattagggctccggg

SEQ ID NO: 54334 - DNA, 20 bp, Artificial Sequence
  sgRNA
  Slc19a3_13
gggctggtgagattcttgct

SEQ ID NO: 54335 - DNA, 20 bp, Artificial Sequence
  sgRNA
  Slc19a3_14
acacattgcttggctcttgt

SEQ ID NO: 54336 - DNA, 20 bp, Artificial Sequence
  sgRNA
  Slc19a3_15
gcaggttcgtcagggatacc

SEQ ID NO: 54337 - DNA, 20 bp, Artificial Sequence
  sgRNA
  Slc19a3_16
ggataaacccaagagttgct

SEQ ID NO: 54338 - DNA, 20 bp, Artificial Sequence
  sgRNA
  Slc19a3_17
atgattgtggtagatcaaag

SEQ ID NO: 54339 - DNA, 20 bp, Artificial Sequence
  sgRNA
  Slc19a3_18
aactccaccgagcaactctt

SEQ ID NO: 54340 - DNA, 20 bp, Artificial Sequence
  sgRNA
  Slc19a3_19
aaacaagcagagtatcacag

SEQ ID NO: 54341 - DNA, 20 bp, Artificial Sequence
  sgRNA
  Slc19a3_20
ctactgtcggagtatcacac

SEQ ID NO: 54342 - DNA, 20 bp, Artificial Sequence
  sgRNA
  Slc1a1_1
cgactcacctagtaccacgg

SEQ ID NO: 54343 - DNA, 20 bp, Artificial Sequence
  sgRNA
  Slc1a1_2
taggattacagcaatgacgg

SEQ ID NO: 54344 - DNA, 20 bp, Artificial Sequence
  sgRNA
  Slc1a1_3
atcatgctggatacgatcag

SEQ ID NO: 54345 - DNA, 20 bp, Artificial Sequence
  sgRNA
  Slc1a1_4
tcacctgatcaggtccaaca

SEQ ID NO: 54346 - DNA, 20 bp, Artificial Sequence
  sgRNA
  Slc1a1_5
gcgccatacccaaggcaaag

SEQ ID NO: 54347 - DNA, 20 bp, Artificial Sequence
  sgRNA
  Slc1a1_6
tgatcgtgctgagtgctgtg

SEQ ID NO: 54348 - DNA, 20 bp, Artificial Sequence
  sgRNA
  Slc1a1_7
tgttggtgccaccatcaaca

SEQ ID NO: 54349 - DNA, 20 bp, Artificial Sequence
  sgRNA
  Slc1a1_8
atctgagtcttcgttatcga

SEQ ID NO: 54350 - DNA, 20 bp, Artificial Sequence
  sgRNA
  Slc1a1_9
gcagcagccagtgattccgt

SEQ ID NO: 54351 - DNA, 20 bp, Artificial Sequence
  sgRNA
  Slc1a1_10
gccagttacattccgctgtg

SEQ ID NO: 54352 - DNA, 20 bp, Artificial Sequence
  sgRNA
  Slc1a1_11
ttatgtcaatgggggcttcg

SEQ ID NO: 54353 - DNA, 20 bp, Artificial Sequence
  sgRNA
  Slc1a1_12
ggtgccaccatcaacatgga

SEQ ID NO: 54354 - DNA, 20 bp, Artificial Sequence
  sgRNA
  Slc1a1_13
ccgtcccaaacgcatcaccc

SEQ ID NO: 54355 - DNA, 20 bp, Artificial Sequence
  sgRNA
  Slc1a1_14
ttcactttctgagtgacacc

SEQ ID NO: 54356 - DNA, 20 bp, Artificial Sequence
  sgRNA
  Slc1a1_15
gccagtgattccgtaggaag

SEQ ID NO: 54357 - DNA, 20 bp, Artificial Sequence
  sgRNA
  Slc1a1_16
atcacccaggacgttcacca

SEQ ID NO: 54358 - DNA, 20 bp, Artificial Sequence
  sgRNA
  Slc1a1_17
agcactcagcacgatcacca

SEQ ID NO: 54359 - DNA, 20 bp, Artificial Sequence
  sgRNA
  Slc1a1_18
attaggaacaaaatgccaat

SEQ ID NO: 54360 - DNA, 20 bp, Artificial Sequence
  sgRNA
  Slc1a1_19
caatgacaaggccaaagacg

SEQ ID NO: 54361 - DNA, 20 bp, Artificial Sequence
  sgRNA
  Slc1a1_20
atcgtatccagcatgatcac

SEQ ID NO: 54362 - DNA, 20 bp, Artificial Sequence
  sgRNA
  Slc1a2_1
catgttgatagccttcccgg

SEQ ID NO: 54363 - DNA, 20 bp, Artificial Sequence
  sgRNA
  Slc1a2_2
ccatagctctcgtgcctagg

SEQ ID NO: 54364 - DNA, 20 bp, Artificial Sequence
  sgRNA
  Slc1a2_3
taattgcccataggtctgat

SEQ ID NO: 54365 - DNA, 20 bp, Artificial Sequence
  sgRNA
  Slc1a2_4
gttcatggtttcattcaaca

SEQ ID NO: 54366 - DNA, 20 bp, Artificial Sequence
  sgRNA
  Slc1a2_5
tcaacatgaccacatcaggg

SEQ ID NO: 54367 - DNA, 20 bp, Artificial Sequence
  sgRNA
  Slc1a2_6
ggatggcacagccctttacg

SEQ ID NO: 54368 - DNA, 20 bp, Artificial Sequence
  sgRNA
  Slc1a2_7
gtgggcctcatcattcacgg

SEQ ID NO: 54369 - DNA, 20 bp, Artificial Sequence
  sgRNA
  Slc1a2_8
ttgctttcggcattgccatg

SEQ ID NO: 54370 - DNA, 20 bp, Artificial Sequence
  sgRNA
  Slc1a2_9
gcagtcagctgactttccat

SEQ ID NO: 54371 - DNA, 20 bp, Artificial Sequence
  sgRNA
  Slc1a2_10
tcatgttgatagccttcccg

SEQ ID NO: 54372 - DNA, 20 bp, Artificial Sequence
  sgRNA
  Slc1a2_11
ctatcaacatgaccacatca

SEQ ID NO: 54373 - DNA, 20 bp, Artificial Sequence
  sgRNA
  Slc1a2_12
gctggaaacaggcttgcacc

SEQ ID NO: 54374 - DNA, 20 bp, Artificial Sequence
  sgRNA
  Slc1a2_13
tacatgatcaccgtgatcgt

SEQ ID NO: 54375 - DNA, 20 bp, Artificial Sequence
  sgRNA
  Slc1a2_14
ctagattatcttccaagcaa

SEQ ID NO: 54376 - DNA, 20 bp, Artificial Sequence
  sgRNA
  Slc1a2_15
ggaggccaataccaccaagg

SEQ ID NO: 54377 - DNA, 20 bp, Artificial Sequence
  sgRNA
  Slc1a2_16
acagccaccctggcgagcat

SEQ ID NO: 54378 - DNA, 20 bp, Artificial Sequence
  sgRNA
  Slc1a2_17
ggctgcaccaatgctcgcca

SEQ ID NO: 54379 - DNA, 20 bp, Artificial Sequence
  sgRNA
  Slc1a2_18
gcagtgttgaggaagaacct

SEQ ID NO: 54380 - DNA, 20 bp, Artificial Sequence
  sgRNA
  Slc1a2_19
taatggttgctccgactggg

SEQ ID NO: 54381 - DNA, 20 bp, Artificial Sequence
  sgRNA
  Slc1a2_20
gtttcggtgctttggctcat

SEQ ID NO: 54382 - DNA, 20 bp, Artificial Sequence
  sgRNA
  Slc1a3_1
gtataaaatgagctaccggg

SEQ ID NO: 54383 - DNA, 20 bp, Artificial Sequence
  sgRNA
  Slc1a3_2
gactctgacccggatccggg

SEQ ID NO: 54384 - DNA, 20 bp, Artificial Sequence
  sgRNA
  Slc1a3_3
gaggccgacaatgactgtca

SEQ ID NO: 54385 - DNA, 20 bp, Artificial Sequence
  sgRNA
  Slc1a3_4
aggcttctaccagattggga

SEQ ID NO: 54386 - DNA, 20 bp, Artificial Sequence
  sgRNA
  Slc1a3_5
ggtaacccggaagaacccct

SEQ ID NO: 54387 - DNA, 20 bp, Artificial Sequence
  sgRNA
  Slc1a3_6
gcatcctcttcttgatcgca

SEQ ID NO: 54388 - DNA, 20 bp, Artificial Sequence
  sgRNA
  Slc1a3_7
gctcgacaatccctgctccg

SEQ ID NO: 54389 - DNA, 20 bp, Artificial Sequence
  sgRNA
  Slc1a3_8
tttcctttgtgccctttccg

SEQ ID NO: 54390 - DNA, 20 bp, Artificial Sequence
  sgRNA
  Slc1a3_9
tgttaatggtggcccccacg

SEQ ID NO: 54391 - DNA, 20 bp, Artificial Sequence
  sgRNA
  Slc1a3_10
gaaagttcagagcctcacca

SEQ ID NO: 54392 - DNA, 20 bp, Artificial Sequence
  sgRNA
  Slc1a3_11
tcttccctgcgatcaagaag

SEQ ID NO: 54393 - DNA, 20 bp, Artificial Sequence
  sgRNA
  Slc1a3_12
tcggaaacatgaaggagcag

SEQ ID NO: 54394 - DNA, 20 bp, Artificial Sequence
  sgRNA
  Slc1a3_13
agatgtcagcacgatgacca

SEQ ID NO: 54395 - DNA, 20 bp, Artificial Sequence
  sgRNA
  Slc1a3_14
gattgcccaggacaatgaac

SEQ ID NO: 54396 - DNA, 20 bp, Artificial Sequence
  sgRNA
  Slc1a3_15
agtgaccgtgagcagaacga

SEQ ID NO: 54397 - DNA, 20 bp, Artificial Sequence
  sgRNA
  Slc1a3_16
aaagcaacggagaagagcct

SEQ ID NO: 54398 - DNA, 20 bp, Artificial Sequence
  sgRNA
  Slc1a3_17
taacgaagccatcatgcgat

SEQ ID NO: 54399 - DNA, 20 bp, Artificial Sequence
  sgRNA
  Slc1a3_18
tcctcatgagaagctcccca

SEQ ID NO: 54400 - DNA, 20 bp, Artificial Sequence
  sgRNA
  Slc1a3_19
agccatcatgcgattggtcg

SEQ ID NO: 54401 - DNA, 20 bp, Artificial Sequence
  sgRNA
  Slc1a3_20
gtaaggcatccgggaagatg

SEQ ID NO: 54402 - DNA, 20 bp, Artificial Sequence
  sgRNA
  Slc1a4_1
gtctgcaaccgattacacag

SEQ ID NO: 54403 - DNA, 20 bp, Artificial Sequence
  sgRNA
  Slc1a4_2
tagagccactcctaacacca

SEQ ID NO: 54404 - DNA, 20 bp, Artificial Sequence
  sgRNA
  Slc1a4_3
gatgccacccagacgcccga

SEQ ID NO: 54405 - DNA, 20 bp, Artificial Sequence
  sgRNA
  Slc1a4_4
acccaccaacactcccgaca

SEQ ID NO: 54406 - DNA, 20 bp, Artificial Sequence
  sgRNA
  Slc1a4_5
tggcgttcatcatcaagcca

SEQ ID NO: 54407 - DNA, 20 bp, Artificial Sequence
  sgRNA
  Slc1a4_6
ggtgccgtcgaggtagccgt

SEQ ID NO: 54408 - DNA, 20 bp, Artificial Sequence
  sgRNA
  Slc1a4_7
cttccacatctgttacaacg

SEQ ID NO: 54409 - DNA, 20 bp, Artificial Sequence
  sgRNA
  Slc1a4_8
tcaatgcacttcatcataga

SEQ ID NO: 54410 - DNA, 20 bp, Artificial Sequence
  sgRNA
  Slc1a4_9
gaggcaggacaattcctccg

SEQ ID NO: 54411 - DNA, 20 bp, Artificial Sequence
  sgRNA
  Slc1a4_10
ttagagccactcctaacacc

SEQ ID NO: 54412 - DNA, 20 bp, Artificial Sequence
  sgRNA
  Slc1a4_11
gtgaaagcaaaatacacaag

SEQ ID NO: 54413 - DNA, 20 bp, Artificial Sequence
  sgRNA
  Slc1a4_12
ggatgaggtcttctccctcg

SEQ ID NO: 54414 - DNA, 20 bp, Artificial Sequence
  sgRNA
  Slc1a4_13
ggatgatcatgcgcagcatg

SEQ ID NO: 54415 - DNA, 20 bp, Artificial Sequence
  sgRNA
  Slc1a4_14
cgaacgcccgagacggcgat

SEQ ID NO: 54416 - DNA, 20 bp, Artificial Sequence
  sgRNA
  Slc1a4_15
tctaaagaagctaggccccg

SEQ ID NO: 54417 - DNA, 20 bp, Artificial Sequence
  sgRNA
  Slc1a4_16
ggagtggctctaaagaagct

SEQ ID NO: 54418 - DNA, 20 bp, Artificial Sequence
  sgRNA
  Slc1a4_17
tgacccataacaccagctcg

SEQ ID NO: 54419 - DNA, 20 bp, Artificial Sequence
  sgRNA
  Slc1a4_18
gtgtagacaagaggatcagc

SEQ ID NO: 54420 - DNA, 20 bp, Artificial Sequence
  sgRNA
  Slc1a4_19
cggtgagcagcaccagcgcg

SEQ ID NO: 54421 - DNA, 20 bp, Artificial Sequence
  sgRNA
  Slc1a4_20
atgttgaccgtggccccaat

SEQ ID NO: 54422 - DNA, 20 bp, Artificial Sequence
  sgRNA
  Slc1a5_1
aatccctatcgattcctgtg

SEQ ID NO: 54423 - DNA, 20 bp, Artificial Sequence
  sgRNA
  Slc1a5_2
tacaacagagtcgttgatgg

SEQ ID NO: 54424 - DNA, 20 bp, Artificial Sequence
  sgRNA
  Slc1a5_3
gcgggagatcaattcaacca

SEQ ID NO: 54425 - DNA, 20 bp, Artificial Sequence
  sgRNA
  Slc1a5_4
gtggtgtgcagcctgatcgg

SEQ ID NO: 54426 - DNA, 20 bp, Artificial Sequence
  sgRNA
  Slc1a5_5
gttcatcgcacaactaaacg

SEQ ID NO: 54427 - DNA, 20 bp, Artificial Sequence
  sgRNA
  Slc1a5_6
agccggttcatcctacccat

SEQ ID NO: 54428 - DNA, 20 bp, Artificial Sequence
  sgRNA
  Slc1a5_7
atgttgaccgtggcgccgat

SEQ ID NO: 54429 - DNA, 20 bp, Artificial Sequence
  sgRNA
  Slc1a5_8
ggtcaccacactgctcgcgt

SEQ ID NO: 54430 - DNA, 20 bp, Artificial Sequence
  sgRNA
  Slc1a5_9
ggcgaaagcggtcaagcgcg

SEQ ID NO: 54431 - DNA, 20 bp, Artificial Sequence
  sgRNA
  Slc1a5_10
gtgtggccaaacacatcagc

SEQ ID NO: 54432 - DNA, 20 bp, Artificial Sequence
  sgRNA
  Slc1a5_11
tggactgcttcagagttacg

SEQ ID NO: 54433 - DNA, 20 bp, Artificial Sequence
  sgRNA
  Slc1a5_12
gcaggttggcgcgaatgcag

SEQ ID NO: 54434 - DNA, 20 bp, Artificial Sequence
  sgRNA
  Slc1a5_13
catccagtgtcggtgcggca

SEQ ID NO: 54435 - DNA, 20 bp, Artificial Sequence
  sgRNA
  Slc1a5_14
atcaggctgcacaccacgag

SEQ ID NO: 54436 - DNA, 20 bp, Artificial Sequence
  sgRNA
  Slc1a5_15
tggttgaattgatctcccgc

SEQ ID NO: 54437 - DNA, 20 bp, Artificial Sequence
  sgRNA
  Slc1a5_16
gtcctgtactgtcctcaacg

SEQ ID NO: 54438 - DNA, 20 bp, Artificial Sequence
  sgRNA
  Slc1a5_17
attgatccaggtgaagaacg

SEQ ID NO: 54439 - DNA, 20 bp, Artificial Sequence
  sgRNA
  Slc1a5_18
ccacacgaccgagcgcgcta

SEQ ID NO: 54440 - DNA, 20 bp, Artificial Sequence
  sgRNA
  Slc1a5_19
tccctggtactgtttcagga

SEQ ID NO: 54441 - DNA, 20 bp, Artificial Sequence
  sgRNA
  Slc1a5_20
gatgccccacaggaatcgat

SEQ ID NO: 54442 - DNA, 20 bp, Artificial Sequence
  sgRNA
  Slc1a6_1
acagcacacgagtggtgaca

SEQ ID NO: 54443 - DNA, 20 bp, Artificial Sequence
  sgRNA
  Slc1a6_2
attggtggcatgaagcacaa

SEQ ID NO: 54444 - DNA, 20 bp, Artificial Sequence
  sgRNA
  Slc1a6_3
ccatgacccgagagcacgtg

SEQ ID NO: 54445 - DNA, 20 bp, Artificial Sequence
  sgRNA
  Slc1a6_4
gaagggaaaggggttccgat

SEQ ID NO: 54446 - DNA, 20 bp, Artificial Sequence
  sgRNA
  Slc1a6_5
ggatgtgagcacaatcacca

SEQ ID NO: 54447 - DNA, 20 bp, Artificial Sequence
  sgRNA
  Slc1a6_6
gtttgaagcaggcctccaca

SEQ ID NO: 54448 - DNA, 20 bp, Artificial Sequence
  sgRNA
  Slc1a6_7
tctacttcctcgtcacccat

SEQ ID NO: 54449 - DNA, 20 bp, Artificial Sequence
  sgRNA
  Slc1a6_8
gtgattgtgctcacatccgt

SEQ ID NO: 54450 - DNA, 20 bp, Artificial Sequence
  sgRNA
  Slc1a6_9
gcctcaatgaggctattatg

SEQ ID NO: 54451 - DNA, 20 bp, Artificial Sequence
  sgRNA
  Slc1a6_10
tgatgcgacgatccacaccc

SEQ ID NO: 54452 - DNA, 20 bp, Artificial Sequence
  sgRNA
  Slc1a6_11
catcacactgatcatagctg

SEQ ID NO: 54453 - DNA, 20 bp, Artificial Sequence
  sgRNA
  Slc1a6_12
aggagcagctggcatccccc

SEQ ID NO: 54454 - DNA, 20 bp, Artificial Sequence
  sgRNA
  Slc1a6_13
aatcgaatcccccagtacat

SEQ ID NO: 54455 - DNA, 20 bp, Artificial Sequence
  sgRNA
  Slc1a6_14
gccaccaatgaccagcccaa

SEQ ID NO: 54456 - DNA, 20 bp, Artificial Sequence
  sgRNA
  Slc1a6_15
gacacagtacagcacacgag

SEQ ID NO: 54457 - DNA, 20 bp, Artificial Sequence
  sgRNA
  Slc1a6_16
tgtagcataccaccaatgaa

SEQ ID NO: 54458 - DNA, 20 bp, Artificial Sequence
  sgRNA
  Slc1a6_17
gtgtggatcgtcgcatcacc

SEQ ID NO: 54459 - DNA, 20 bp, Artificial Sequence
  sgRNA
  Slc1a6_18
tgtgccatgagtgacttata

SEQ ID NO: 54460 - DNA, 20 bp, Artificial Sequence
  sgRNA
  Slc1a6_19
gtttccacctaaccttgtgg

SEQ ID NO: 54461 - DNA, 20 bp, Artificial Sequence
  sgRNA
  Slc1a6_20
gcctcataatagcctcattg

SEQ ID NO: 54462 - DNA, 20 bp, Artificial Sequence
  sgRNA
  Slc1a7_1
gtgacaacacatacccatcg

SEQ ID NO: 54463 - DNA, 20 bp, Artificial Sequence
  sgRNA
  Slc1a7_2
agtccacaggtagtatgcca

SEQ ID NO: 54464 - DNA, 20 bp, Artificial Sequence
  sgRNA
  Slc1a7_3
ccggcggatcgtcatctatg

SEQ ID NO: 54465 - DNA, 20 bp, Artificial Sequence
  sgRNA
  Slc1a7_4
gtgatgaggaagtacagtag

SEQ ID NO: 54466 - DNA, 20 bp, Artificial Sequence
  sgRNA
  Slc1a7_5
gcatcagctgagctcatgac

SEQ ID NO: 54467 - DNA, 20 bp, Artificial Sequence
  sgRNA
  Slc1a7_6
ccatagatgacgatccgccg

SEQ ID NO: 54468 - DNA, 20 bp, Artificial Sequence
  sgRNA
  Slc1a7_7
gcacgaagcgagcgatgcgg

SEQ ID NO: 54469 - DNA, 20 bp, Artificial Sequence
  sgRNA
  Slc1a7_8
gtttgaacgtggcttctacc

SEQ ID NO: 54470 - DNA, 20 bp, Artificial Sequence
  sgRNA
  Slc1a7_9
tccgcatcaagagttctcca

SEQ ID NO: 54471 - DNA, 20 bp, Artificial Sequence
  sgRNA
  Slc1a7_10
aaccccatcgtcttcatccg

SEQ ID NO: 54472 - DNA, 20 bp, Artificial Sequence
  sgRNA
  Slc1a7_11
ccttctgtgctgcaccacca

SEQ ID NO: 54473 - DNA, 20 bp, Artificial Sequence
  sgRNA
  Slc1a7_12
tgtgggcgccaccatcaaca

SEQ ID NO: 54474 - DNA, 20 bp, Artificial Sequence
  sgRNA
  Slc1a7_13
atgaggttgatgtcatcggt

SEQ ID NO: 54475 - DNA, 20 bp, Artificial Sequence
  sgRNA
  Slc1a7_14
agccacggcctcgtagagcg

SEQ ID NO: 54476 - DNA, 20 bp, Artificial Sequence
  sgRNA
  Slc1a7_15
tctgtgctctctgtcatcgt

SEQ ID NO: 54477 - DNA, 20 bp, Artificial Sequence
  sgRNA
  Slc1a7_16
ggtatcatgctgggccgcat

SEQ ID NO: 54478 - DNA, 20 bp, Artificial Sequence
  sgRNA
  Slc1a7_17
gtctccatcatccaccctgg

SEQ ID NO: 54479 - DNA, 20 bp, Artificial Sequence
  sgRNA
  Slc1a7_18
tgtcatgaagatcgtggcag

SEQ ID NO: 54480 - DNA, 20 bp, Artificial Sequence
  sgRNA
  Slc1a7_19
tgaagatcgtggcagtggca

SEQ ID NO: 54481 - DNA, 20 bp, Artificial Sequence
  sgRNA
  Slc1a7_20
cttcacacagccattctgct

SEQ ID NO: 54482 - DNA, 20 bp, Artificial Sequence
  sgRNA
  Slc20a2_1
atactgtacacaaagactcg

SEQ ID NO: 54483 - DNA, 20 bp, Artificial Sequence
  sgRNA
  Slc20a2_2
gccttaccataggaagcccg

SEQ ID NO: 54484 - DNA, 20 bp, Artificial Sequence
  sgRNA
  Slc20a2_3
aagtggcgatataaaccagg

SEQ ID NO: 54485 - DNA, 20 bp, Artificial Sequence
  sgRNA
  Slc20a2_4
atggtagcagcataaaacag

SEQ ID NO: 54486 - DNA, 20 bp, Artificial Sequence
  sgRNA
  Slc20a2_5
gaatctctacaacgagaccg

SEQ ID NO: 54487 - DNA, 20 bp, Artificial Sequence
  sgRNA
  Slc20a2_6
gcaatagcgctcatatcctt

SEQ ID NO: 54488 - DNA, 20 bp, Artificial Sequence
  sgRNA
  Slc20a2_7
gattagtatgaacagcacgc

SEQ ID NO: 54489 - DNA, 20 bp, Artificial Sequence
  sgRNA
  Slc20a2_8
gatccagcccacagctacca

SEQ ID NO: 54490 - DNA, 20 bp, Artificial Sequence
  sgRNA
  Slc20a2_9
tgccaattccttcggaaccg

SEQ ID NO: 54491 - DNA, 20 bp, Artificial Sequence
  sgRNA
  Slc20a2_10
aattccttcggaaccgcggt

SEQ ID NO: 54492 - DNA, 20 bp, Artificial Sequence
  sgRNA
  Slc20a2_11
ccacgtagacaggggctccg

SEQ ID NO: 54493 - DNA, 20 bp, Artificial Sequence
  sgRNA
  Slc20a2_12
gctggcctctgccttcaccg

SEQ ID NO: 54494 - DNA, 20 bp, Artificial Sequence
  sgRNA
  Slc20a2_13
gcctcacgaggaccccacgg

SEQ ID NO: 54495 - DNA, 20 bp, Artificial Sequence
  sgRNA
  Slc20a2_14
atatcagccacaaagccaca

SEQ ID NO: 54496 - DNA, 20 bp, Artificial Sequence
  sgRNA
  Slc20a2_15
tggcaccgactgaaaacgcc

SEQ ID NO: 54497 - DNA, 20 bp, Artificial Sequence
  sgRNA
  Slc20a2_16
gatgttggaggcaatcacca

SEQ ID NO: 54498 - DNA, 20 bp, Artificial Sequence
  sgRNA
  Slc20a2_17
gggacagcgctgtcatcgct

SEQ ID NO: 54499 - DNA, 20 bp, Artificial Sequence
  sgRNA
  Slc20a2_18
gtcaatgatgcctttccgaa

SEQ ID NO: 54500 - DNA, 20 bp, Artificial Sequence
  sgRNA
  Slc20a2_19
ttcgggtccttcgctcacgg

SEQ ID NO: 54501 - DNA, 20 bp, Artificial Sequence
  sgRNA
  Slc20a2_20
gcttccatatttgaaaccac

SEQ ID NO: 54502 - DNA, 20 bp, Artificial Sequence
  sgRNA
  Slc22a1_1
gaagaagcccaagttcacac

SEQ ID NO: 54503 - DNA, 20 bp, Artificial Sequence
  sgRNA
  Slc22a1_2
tgttaacacgccagacaggg

SEQ ID NO: 54504 - DNA, 20 bp, Artificial Sequence
  sgRNA
  Slc22a1_3
cggaacaggtctgcaaacga

SEQ ID NO: 54505 - DNA, 20 bp, Artificial Sequence
  sgRNA
  Slc22a1_4
tctttagctcccatctacgt

SEQ ID NO: 54506 - DNA, 20 bp, Artificial Sequence
  sgRNA
  Slc22a1_5
ggtttgtcccagaatccccc

SEQ ID NO: 54507 - DNA, 20 bp, Artificial Sequence
  sgRNA
  Slc22a1_6
catacggccaagacaagcga

SEQ ID NO: 54508 - DNA, 20 bp, Artificial Sequence
  sgRNA
  Slc22a1_7
gtaccaggtggccttcacag

SEQ ID NO: 54509 - DNA, 20 bp, Artificial Sequence
  sgRNA
  Slc22a1_8
ccatacggccaagacaagcg

SEQ ID NO: 54510 - DNA, 20 bp, Artificial Sequence
  sgRNA
  Slc22a1_9
cttctacttccggagaccaa

SEQ ID NO: 54511 - DNA, 20 bp, Artificial Sequence
  sgRNA
  Slc22a1_10
tgcaatgtaacccacaacca

SEQ ID NO: 54512 - DNA, 20 bp, Artificial Sequence
  sgRNA
  Slc22a1_11
gcgccagtctggaatggcat

SEQ ID NO: 54513 - DNA, 20 bp, Artificial Sequence
  sgRNA
  Slc22a1_12
ttctctagtggaattccctg

SEQ ID NO: 54514 - DNA, 20 bp, Artificial Sequence
  sgRNA
  Slc22a1_13
caaggatgataaaggccgca

SEQ ID NO: 54515 - DNA, 20 bp, Artificial Sequence
  sgRNA
  Slc22a1_14
atgccgctattgggtagatg

SEQ ID NO: 54516 - DNA, 20 bp, Artificial Sequence
  sgRNA
  Slc22a1_15
ctgagacaacagccaccggg

SEQ ID NO: 54517 - DNA, 20 bp, Artificial Sequence
  sgRNA
  Slc22a1_16
gatcccacctaggtcacaca

SEQ ID NO: 54518 - DNA, 20 bp, Artificial Sequence
  sgRNA
  Slc22a1_17
tctgagacaacagccaccgg

SEQ ID NO: 54519 - DNA, 20 bp, Artificial Sequence
  sgRNA
  Slc22a1_18
ggtacagctcagcgttcact

SEQ ID NO: 54520 - DNA, 20 bp, Artificial Sequence
  sgRNA
  Slc22a1_19
atgccattccagactggcgc

SEQ ID NO: 54521 - DNA, 20 bp, Artificial Sequence
  sgRNA
  Slc22a1_20
tcttgtgctgtgctgtacca

SEQ ID NO: 54522 - DNA, 20 bp, Artificial Sequence
  sgRNA
  Slc22a12_1
gggcctgggagttacatacc

SEQ ID NO: 54523 - DNA, 20 bp, Artificial Sequence
  sgRNA
  Slc22a12_2
acggtaggcaagctggacca

SEQ ID NO: 54524 - DNA, 20 bp, Artificial Sequence
  sgRNA
  Slc22a12_3
gaggtgctattgtccaggag

SEQ ID NO: 54525 - DNA, 20 bp, Artificial Sequence
  sgRNA
  Slc22a12_4
catcaccaaagggctaccct

SEQ ID NO: 54526 - DNA, 20 bp, Artificial Sequence
  sgRNA
  Slc22a12_5
gcttacagagtccaacgcca

SEQ ID NO: 54527 - DNA, 20 bp, Artificial Sequence
  sgRNA
  Slc22a12_6
cgttcaaggtcatcaccaaa

SEQ ID NO: 54528 - DNA, 20 bp, Artificial Sequence
  sgRNA
  Slc22a12_7
ctcccaggcgagtatccctg

SEQ ID NO: 54529 - DNA, 20 bp, Artificial Sequence
  sgRNA
  Slc22a12_8
agtggcagcgtcactccagt

SEQ ID NO: 54530 - DNA, 20 bp, Artificial Sequence
  sgRNA
  Slc22a12_9
gtaacacatgacacaccaga

SEQ ID NO: 54531 - DNA, 20 bp, Artificial Sequence
  sgRNA
  Slc22a12_10
gctccatcctgatgtctacc

SEQ ID NO: 54532 - DNA, 20 bp, Artificial Sequence
  sgRNA
  Slc22a12_11
gggtcaccagagccaccgtc

SEQ ID NO: 54533 - DNA, 20 bp, Artificial Sequence
  sgRNA
  Slc22a12_12
gggtagctgctgtcaacagg

SEQ ID NO: 54534 - DNA, 20 bp, Artificial Sequence
  sgRNA
  Slc22a12_13
gggcctgcaggaactacaga

SEQ ID NO: 54535 - DNA, 20 bp, Artificial Sequence
  sgRNA
  Slc22a12_14
gcacagccagggccgagcga

SEQ ID NO: 54536 - DNA, 20 bp, Artificial Sequence
  sgRNA
  Slc22a12_15
ggagtggtgccagtgttaag

SEQ ID NO: 54537 - DNA, 20 bp, Artificial Sequence
  sgRNA
  Slc22a12_16
ggtggtgacccacaaaatgg

SEQ ID NO: 54538 - DNA, 20 bp, Artificial Sequence
  sgRNA
  Slc22a12_17
tggacaggatgcagagtccg

SEQ ID NO: 54539 - DNA, 20 bp, Artificial Sequence
  sgRNA
  Slc22a12_18
cctatggtgtgcgcagctgg

SEQ ID NO: 54540 - DNA, 20 bp, Artificial Sequence
  sgRNA
  Slc22a12_19
ccaacgccacggccaccaac

SEQ ID NO: 54541 - DNA, 20 bp, Artificial Sequence
  sgRNA
  Slc22a12_20
attgaggttgtcggaagcgg

SEQ ID NO: 54542 - DNA, 20 bp, Artificial Sequence
  sgRNA
  Slc22a13_1
cctgaagaagacctcccagt

SEQ ID NO: 54543 - DNA, 20 bp, Artificial Sequence
  sgRNA
  Slc22a13_2
agtagccaagacaaagcgta

SEQ ID NO: 54544 - DNA, 20 bp, Artificial Sequence
  sgRNA
  Slc22a13_3
gaagagcagtaagacgggtg

SEQ ID NO: 54545 - DNA, 20 bp, Artificial Sequence
  sgRNA
  Slc22a13_4
atcttggagaacacaagccg

SEQ ID NO: 54546 - DNA, 20 bp, Artificial Sequence
  sgRNA
  Slc22a13_5
gttggtgagcatcttctcca

SEQ ID NO: 54547 - DNA, 20 bp, Artificial Sequence
  sgRNA
  Slc22a13_6
cccagagcaacgttgccctt

SEQ ID NO: 54548 - DNA, 20 bp, Artificial Sequence
  sgRNA
  Slc22a13_7
gttgctctgggccaagacca

SEQ ID NO: 54549 - DNA, 20 bp, Artificial Sequence
  sgRNA
  Slc22a13_8
cagaagcacctgcatcagga

SEQ ID NO: 54550 - DNA, 20 bp, Artificial Sequence
  sgRNA
  Slc22a13_9
gaccagccatgaacaccgac

SEQ ID NO: 54551 - DNA, 20 bp, Artificial Sequence
  sgRNA
  Slc22a13_10
cagtagccaagacaaagcgt

SEQ ID NO: 54552 - DNA, 20 bp, Artificial Sequence
  sgRNA
  Slc22a13_11
gtgcggtgcctgttatctga

SEQ ID NO: 54553 - DNA, 20 bp, Artificial Sequence
  sgRNA
  Slc22a13_12
acggcttgtgttctccaaga

SEQ ID NO: 54554 - DNA, 20 bp, Artificial Sequence
  sgRNA
  Slc22a13_13
acttagtaaaaatccagcat

SEQ ID NO: 54555 - DNA, 20 bp, Artificial Sequence
  sgRNA
  Slc22a13_14
gtgagcatcttctccagggt

SEQ ID NO: 54556 - DNA, 20 bp, Artificial Sequence
  sgRNA
  Slc22a13_15
gatgggcattcccaatttcc

SEQ ID NO: 54557 - DNA, 20 bp, Artificial Sequence
  sgRNA
  Slc22a13_16
tctgaaggagtctccagttt

SEQ ID NO: 54558 - DNA, 20 bp, Artificial Sequence
  sgRNA
  Slc22a13_17
tggagactccttcagataac

SEQ ID NO: 54559 - DNA, 20 bp, Artificial Sequence
  sgRNA
  Slc22a13_18
ggccaagtagagctcaaagc

SEQ ID NO: 54560 - DNA, 20 bp, Artificial Sequence
  sgRNA
  Slc22a13_19
agcacctgcatcaggaggga

SEQ ID NO: 54561 - DNA, 20 bp, Artificial Sequence
  sgRNA
  Slc22a13_20
gctctgcttcctgagacccg

SEQ ID NO: 54562 - DNA, 20 bp, Artificial Sequence
  sgRNA
  Slc22a13b-ps_1
gttggtgagcatgttctcca

SEQ ID NO: 54563 - DNA, 20 bp, Artificial Sequence
  sgRNA
  Slc22a13b-ps_2
cctgaagaggacctctcagt

SEQ ID NO: 54564 - DNA, 20 bp, Artificial Sequence
  sgRNA
  Slc22a13b-ps_3
ggttctttcaatcacacacc

SEQ ID NO: 54565 - DNA, 20 bp, Artificial Sequence
  sgRNA
  Slc22a13b-ps_4
ggtcttcatggtccttgacg

SEQ ID NO: 54566 - DNA, 20 bp, Artificial Sequence
  sgRNA
  Slc22a13b-ps_5
gtgagcatgttctccagggt

SEQ ID NO: 54567 - DNA, 20 bp, Artificial Sequence
  sgRNA
  Slc22a13b-ps_6
gctcttcttcctgagtcccg

SEQ ID NO: 54568 - DNA, 20 bp, Artificial Sequence
  sgRNA
  Slc22a13b-ps_7
agccatgaacaccgactgag

SEQ ID NO: 54569 - DNA, 20 bp, Artificial Sequence
  sgRNA
  Slc22a13b-ps_8
cattctttagggactgaggc

SEQ ID NO: 54570 - DNA, 20 bp, Artificial Sequence
  sgRNA
  Slc22a13b-ps_9
gcgctcttcttcctgagtcc

SEQ ID NO: 54571 - DNA, 20 bp, Artificial Sequence
  sgRNA
  Slc22a13b-ps_10
tctcagtcggtgttcatggc

SEQ ID NO: 54572 - DNA, 20 bp, Artificial Sequence
  sgRNA
  Slc22a13b-ps_11
cgtcaaggaccatgaagacc

SEQ ID NO: 54573 - DNA, 20 bp, Artificial Sequence
  sgRNA
  Slc22a13b-ps_12
tggacttcttgttggagccc

SEQ ID NO: 54574 - DNA, 20 bp, Artificial Sequence
  sgRNA
  Slc22a13b-ps_13
caggaagaagagcgcacagt

SEQ ID NO: 54575 - DNA, 20 bp, Artificial Sequence
  sgRNA
  Slc22a13b-ps_14
gtgattgaaagaacctgaag

SEQ ID NO: 54576 - DNA, 20 bp, Artificial Sequence
  sgRNA
  Slc22a13b-ps_15
aagaatgcagtcaggaaatt

SEQ ID NO: 54577 - DNA, 20 bp, Artificial Sequence
  sgRNA
  Slc22a13b-ps_16
aacagtggtgagcctcgtca

SEQ ID NO: 54578 - DNA, 20 bp, Artificial Sequence
  sgRNA
  Slc22a13b-ps_17
ttcatggctggacttcttgt

SEQ ID NO: 54579 - DNA, 20 bp, Artificial Sequence
  sgRNA
  Slc22a13b-ps_18
agcatgttctccagggtcgg

SEQ ID NO: 54580 - DNA, 20 bp, Artificial Sequence
  sgRNA
  Slc22a13b-ps_19
ctgactgcattcttcatatt

SEQ ID NO: 54581 - DNA, 20 bp, Artificial Sequence
  sgRNA
  Slc22a13b-ps_20
ccgactgagaggtcctcttc

SEQ ID NO: 54582 - DNA, 20 bp, Artificial Sequence
  sgRNA
  Slc22a14_1
atggcacaggtatatacatg

SEQ ID NO: 54583 - DNA, 20 bp, Artificial Sequence
  sgRNA
  Slc22a14_2
ttctccgagagtccccacga

SEQ ID NO: 54584 - DNA, 20 bp, Artificial Sequence
  sgRNA
  Slc22a14_3
taggggtcatactcctgacg

SEQ ID NO: 54585 - DNA, 20 bp, Artificial Sequence
  sgRNA
  Slc22a14_4
cacccgttctctgatcaatg

SEQ ID NO: 54586 - DNA, 20 bp, Artificial Sequence
  sgRNA
  Slc22a14_5
cgactcctcagctatcacca

SEQ ID NO: 54587 - DNA, 20 bp, Artificial Sequence
  sgRNA
  Slc22a14_6
ggacgtctacttcgtacaaa

SEQ ID NO: 54588 - DNA, 20 bp, Artificial Sequence
  sgRNA
  Slc22a14_7
gcaggatgacggcttgagcg

SEQ ID NO: 54589 - DNA, 20 bp, Artificial Sequence
  sgRNA
  Slc22a14_8
gaaagtcacggcattgagcg

SEQ ID NO: 54590 - DNA, 20 bp, Artificial Sequence
  sgRNA
  Slc22a14_9
agactgctgtgcctgctggg

SEQ ID NO: 54591 - DNA, 20 bp, Artificial Sequence
  sgRNA
  Slc22a14_10
ggagtatgacccctatggtg

SEQ ID NO: 54592 - DNA, 20 bp, Artificial Sequence
  sgRNA
  Slc22a14_11
ggccctactgtaacaccagc

SEQ ID NO: 54593 - DNA, 20 bp, Artificial Sequence
  sgRNA
  Slc22a14_12
tgtaaaactgatgtaactga

SEQ ID NO: 54594 - DNA, 20 bp, Artificial Sequence
  sgRNA
  Slc22a14_13
agtgggccccaatctcacag

SEQ ID NO: 54595 - DNA, 20 bp, Artificial Sequence
  sgRNA
  Slc22a14_14
agaaggttgacaggatgctg

SEQ ID NO: 54596 - DNA, 20 bp, Artificial Sequence
  sgRNA
  Slc22a14_15
actgcagatggcatagccca

SEQ ID NO: 54597 - DNA, 20 bp, Artificial Sequence
  sgRNA
  Slc22a14_16
cacgtcagaaagctgccatt

SEQ ID NO: 54598 - DNA, 20 bp, Artificial Sequence
  sgRNA
  Slc22a14_17
gcagatggcatagcccacgg

SEQ ID NO: 54599 - DNA, 20 bp, Artificial Sequence
  sgRNA
  Slc22a14_18
aatttggcacattccagtgg

SEQ ID NO: 54600 - DNA, 20 bp, Artificial Sequence
  sgRNA
  Slc22a14_19
gatgctgctacgcagattga

SEQ ID NO: 54601 - DNA, 20 bp, Artificial Sequence
  sgRNA
  Slc22a14_20
agcacagcttcctcaccata

SEQ ID NO: 54602 - DNA, 20 bp, Artificial Sequence
  sgRNA
  Slc22a15_1
tagctccaatcagtgcaatg

SEQ ID NO: 54603 - DNA, 20 bp, Artificial Sequence
  sgRNA
  Slc22a15_2
ccgatcttacaaagtcagcg

SEQ ID NO: 54604 - DNA, 20 bp, Artificial Sequence
  sgRNA
  Slc22a15_3
cctcgttggttatactccca

SEQ ID NO: 54605 - DNA, 20 bp, Artificial Sequence
  sgRNA
  Slc22a15_4
gtcttgctaaatgagtgcgt

SEQ ID NO: 54606 - DNA, 20 bp, Artificial Sequence
  sgRNA
  Slc22a15_5
ggtacttcatccgctcctgg

SEQ ID NO: 54607 - DNA, 20 bp, Artificial Sequence
  sgRNA
  Slc22a15_6
gcagtaactcgcttcttggt

SEQ ID NO: 54608 - DNA, 20 bp, Artificial Sequence
  sgRNA
  Slc22a15_7
ctctgtacttcattgccaag

SEQ ID NO: 54609 - DNA, 20 bp, Artificial Sequence
  sgRNA
  Slc22a15_8
agctacaccagcataccact

SEQ ID NO: 54610 - DNA, 20 bp, Artificial Sequence
  sgRNA
  Slc22a15_9
gctgactttgtaagatcggt

SEQ ID NO: 54611 - DNA, 20 bp, Artificial Sequence
  sgRNA
  Slc22a15_10
gctgttctggtcaaccttca

SEQ ID NO: 54612 - DNA, 20 bp, Artificial Sequence
  sgRNA
  Slc22a15_11
tggtgggcatgatgaatgga

SEQ ID NO: 54613 - DNA, 20 bp, Artificial Sequence
  sgRNA
  Slc22a15_12
gtgtgcagcttggtgtacta

SEQ ID NO: 54614 - DNA, 20 bp, Artificial Sequence
  sgRNA
  Slc22a15_13
gatggtcagcttccccagca

SEQ ID NO: 54615 - DNA, 20 bp, Artificial Sequence
  sgRNA
  Slc22a15_14
tcactgctgaccttgtccag

SEQ ID NO: 54616 - DNA, 20 bp, Artificial Sequence
  sgRNA
  Slc22a15_15
ccgcgctgactttgtaagat

SEQ ID NO: 54617 - DNA, 20 bp, Artificial Sequence
  sgRNA
  Slc22a15_16
gatgtacttgtgcttcctgc

SEQ ID NO: 54618 - DNA, 20 bp, Artificial Sequence
  sgRNA
  Slc22a15_17
ccctgggagtataaccaacg

SEQ ID NO: 54619 - DNA, 20 bp, Artificial Sequence
  sgRNA
  Slc22a15_18
ctcactgctgaccttgtcca

SEQ ID NO: 54620 - DNA, 20 bp, Artificial Sequence
  sgRNA
  Slc22a15_19
ttagcaagacaaaggccacc

SEQ ID NO: 54621 - DNA, 20 bp, Artificial Sequence
  sgRNA
  Slc22a15_20
ggtaggatggaatctctatg

SEQ ID NO: 54622 - DNA, 20 bp, Artificial Sequence
  sgRNA
  Slc22a16_1
gctatttgttgaaaacgtgg

SEQ ID NO: 54623 - DNA, 20 bp, Artificial Sequence
  sgRNA
  Slc22a16_2
tcttatcactagatgtgacg

SEQ ID NO: 54624 - DNA, 20 bp, Artificial Sequence
  sgRNA
  Slc22a16_3
atttacgcttacccactagg

SEQ ID NO: 54625 - DNA, 20 bp, Artificial Sequence
  sgRNA
  Slc22a16_4
tagacgtagccatcgaagca

SEQ ID NO: 54626 - DNA, 20 bp, Artificial Sequence
  sgRNA
  Slc22a16_5
agctgtatccaacaaccgta

SEQ ID NO: 54627 - DNA, 20 bp, Artificial Sequence
  sgRNA
  Slc22a16_6
aggtgagcgaggacaccaag

SEQ ID NO: 54628 - DNA, 20 bp, Artificial Sequence
  sgRNA
  Slc22a16_7
gccgatgctcgtgcaccaca

SEQ ID NO: 54629 - DNA, 20 bp, Artificial Sequence
  sgRNA
  Slc22a16_8
ggatgaagatgctcgacacg

SEQ ID NO: 54630 - DNA, 20 bp, Artificial Sequence
  sgRNA
  Slc22a16_9
ctagtgataagagctctacc

SEQ ID NO: 54631 - DNA, 20 bp, Artificial Sequence
  sgRNA
  Slc22a16_10
ccttgtatcttccttctgag

SEQ ID NO: 54632 - DNA, 20 bp, Artificial Sequence
  sgRNA
  Slc22a16_11
tccacaacgtatctgcttgg

SEQ ID NO: 54633 - DNA, 20 bp, Artificial Sequence
  sgRNA
  Slc22a16_12
gagataatcaaatataaaga

SEQ ID NO: 54634 - DNA, 20 bp, Artificial Sequence
  sgRNA
  Slc22a16_13
gatagtggataccacaagag

SEQ ID NO: 54635 - DNA, 20 bp, Artificial Sequence
  sgRNA
  Slc22a16_14
gcacaaagatcacatcatgg

SEQ ID NO: 54636 - DNA, 20 bp, Artificial Sequence
  sgRNA
  Slc22a16_15
gagcatgcgtgcaagccccc

SEQ ID NO: 54637 - DNA, 20 bp, Artificial Sequence
  sgRNA
  Slc22a16_16
gatgaagatgctcgacacgt

SEQ ID NO: 54638 - DNA, 20 bp, Artificial Sequence
  sgRNA
  Slc22a16_17
ctttatttatctttatacgg

SEQ ID NO: 54639 - DNA, 20 bp, Artificial Sequence
  sgRNA
  Slc22a16_18
gcagagtccctcctgatgct

SEQ ID NO: 54640 - DNA, 20 bp, Artificial Sequence
  sgRNA
  Slc22a16_19
gctcacctgtatgctgcatg

SEQ ID NO: 54641 - DNA, 20 bp, Artificial Sequence
  sgRNA
  Slc22a16_20
gagatgtagcaggacttgga

SEQ ID NO: 54642 - DNA, 20 bp, Artificial Sequence
  sgRNA
  Slc22a17_1
ttctctcaatgactctcacg

SEQ ID NO: 54643 - DNA, 20 bp, Artificial Sequence
  sgRNA
  Slc22a17_2
gaggcccaggaagctttgca

SEQ ID NO: 54644 - DNA, 20 bp, Artificial Sequence
  sgRNA
  Slc22a17_3
gcagactccagaaacagacc

SEQ ID NO: 54645 - DNA, 20 bp, Artificial Sequence
  sgRNA
  Slc22a17_4
atcgccagtccttagagaca

SEQ ID NO: 54646 - DNA, 20 bp, Artificial Sequence
  sgRNA
  Slc22a17_5
tcagcagcacaatcccacga

SEQ ID NO: 54647 - DNA, 20 bp, Artificial Sequence
  sgRNA
  Slc22a17_6
gtgctcaccaccaatgccat

SEQ ID NO: 54648 - DNA, 20 bp, Artificial Sequence
  sgRNA
  Slc22a17_7
ggatgccccgacggccaaaa

SEQ ID NO: 54649 - DNA, 20 bp, Artificial Sequence
  sgRNA
  Slc22a17_8
acctgtccgcggggtaaccg

SEQ ID NO: 54650 - DNA, 20 bp, Artificial Sequence
  sgRNA
  Slc22a17_9
gatgttgcggtagttgagga

SEQ ID NO: 54651 - DNA, 20 bp, Artificial Sequence
  sgRNA
  Slc22a17_10
caacaaaatcgacagcgccg

SEQ ID NO: 54652 - DNA, 20 bp, Artificial Sequence
  sgRNA
  Slc22a17_11
gggttaggagtggctagcag

SEQ ID NO: 54653 - DNA, 20 bp, Artificial Sequence
  sgRNA
  Slc22a17_12
cctgttcctcggttaccccg

SEQ ID NO: 54654 - DNA, 20 bp, Artificial Sequence
  sgRNA
  Slc22a17_13
agagaagcaggatgccccga

SEQ ID NO: 54655 - DNA, 20 bp, Artificial Sequence
  sgRNA
  Slc22a17_14
acatggtcacagcggttagg

SEQ ID NO: 54656 - DNA, 20 bp, Artificial Sequence
  sgRNA
  Slc22a17_15
tcgaagctgaggggtcccgg

SEQ ID NO: 54657 - DNA, 20 bp, Artificial Sequence
  sgRNA
  Slc22a17_16
agctgtgcgacccaacccag

SEQ ID NO: 54658 - DNA, 20 bp, Artificial Sequence
  sgRNA
  Slc22a17_17
agacttcaaccactgcctga

SEQ ID NO: 54659 - DNA, 20 bp, Artificial Sequence
  sgRNA
  Slc22a17_18
gtagcagtggcgaatggcat

SEQ ID NO: 54660 - DNA, 20 bp, Artificial Sequence
  sgRNA
  Slc22a17_19
gtagttgaggagggacgcaa

SEQ ID NO: 54661 - DNA, 20 bp, Artificial Sequence
  sgRNA
  Slc22a17_20
cctgcagcatgtggtactgg

SEQ ID NO: 54662 - DNA, 20 bp, Artificial Sequence
  sgRNA
  Slc22a19_1
actgtggttgaatatagcga

SEQ ID NO: 54663 - DNA, 20 bp, Artificial Sequence
  sgRNA
  Slc22a19_2
tgtacggaacaagtccagtg

SEQ ID NO: 54664 - DNA, 20 bp, Artificial Sequence
  sgRNA
  Slc22a19_3
gttggacagacactgttggg

SEQ ID NO: 54665 - DNA, 20 bp, Artificial Sequence
  sgRNA
  Slc22a19_4
gttaatctgccatgccctgt

SEQ ID NO: 54666 - DNA, 20 bp, Artificial Sequence
  sgRNA
  Slc22a19_5
gtacacctaaccttcgcaag

SEQ ID NO: 54667 - DNA, 20 bp, Artificial Sequence
  sgRNA
  Slc22a19_6
gtgtacggaacaagtccagt

SEQ ID NO: 54668 - DNA, 20 bp, Artificial Sequence
  sgRNA
  Slc22a19_7
gtcgctatattcaaccacag

SEQ ID NO: 54669 - DNA, 20 bp, Artificial Sequence
  sgRNA
  Slc22a19_8
gcaacgaggccaccaaggaa

SEQ ID NO: 54670 - DNA, 20 bp, Artificial Sequence
  sgRNA
  Slc22a19_9
gtaggaacacattattgctt

SEQ ID NO: 54671 - DNA, 20 bp, Artificial Sequence
  sgRNA
  Slc22a19_10
actgcagtgtctctatggtg

SEQ ID NO: 54672 - DNA, 20 bp, Artificial Sequence
  sgRNA
  Slc22a19_11
atgttgacaaaaatacacgc

SEQ ID NO: 54673 - DNA, 20 bp, Artificial Sequence
  sgRNA
  Slc22a19_12
ggagacagatccgcttgcga

SEQ ID NO: 54674 - DNA, 20 bp, Artificial Sequence
  sgRNA
  Slc22a19_13
ggttgtcagagtcagctcga

SEQ ID NO: 54675 - DNA, 20 bp, Artificial Sequence
  sgRNA
  Slc22a19_14
tcttactccttattcccaca

SEQ ID NO: 54676 - DNA, 20 bp, Artificial Sequence
  sgRNA
  Slc22a19_15
gcaactgctttaggagtcgt

SEQ ID NO: 54677 - DNA, 20 bp, Artificial Sequence
  sgRNA
  Slc22a19_16
aggaagcagagtatgtcgtg

SEQ ID NO: 54678 - DNA, 20 bp, Artificial Sequence
  sgRNA
  Slc22a19_17
ccttgccctggatcatctat

SEQ ID NO: 54679 - DNA, 20 bp, Artificial Sequence
  sgRNA
  Slc22a19_18
aatttccaagaacattggct

SEQ ID NO: 54680 - DNA, 20 bp, Artificial Sequence
  sgRNA
  Slc22a19_19
aaagagtgtgaggagccgac

SEQ ID NO: 54681 - DNA, 20 bp, Artificial Sequence
  sgRNA
  Slc22a19_20
gtgtctggctctgttacagt

SEQ ID NO: 54682 - DNA, 20 bp, Artificial Sequence
  sgRNA
  Slc22a2_1
ttggtgtttcgatttctaca

SEQ ID NO: 54683 - DNA, 20 bp, Artificial Sequence
  sgRNA
  Slc22a2_2
aaacgatgcccacatagatg

SEQ ID NO: 54684 - DNA, 20 bp, Artificial Sequence
  sgRNA
  Slc22a2_3
ttcagtcattagtgaacgtg

SEQ ID NO: 54685 - DNA, 20 bp, Artificial Sequence
  sgRNA
  Slc22a2_4
ggagactccggtatgcacct

SEQ ID NO: 54686 - DNA, 20 bp, Artificial Sequence
  sgRNA
  Slc22a2_5
gattggtcgccgctatccct

SEQ ID NO: 54687 - DNA, 20 bp, Artificial Sequence
  sgRNA
  Slc22a2_6
acagtggctgaaaattaccg

SEQ ID NO: 54688 - DNA, 20 bp, Artificial Sequence
  sgRNA
  Slc22a2_7
agtagatgttgtcccctgcg

SEQ ID NO: 54689 - DNA, 20 bp, Artificial Sequence
  sgRNA
  Slc22a2_8
tcatgcacatgggcctcgca

SEQ ID NO: 54690 - DNA, 20 bp, Artificial Sequence
  sgRNA
  Slc22a2_9
gcacaagtcccccagcaaca

SEQ ID NO: 54691 - DNA, 20 bp, Artificial Sequence
  sgRNA
  Slc22a2_10
atgcccttcccaactggagg

SEQ ID NO: 54692 - DNA, 20 bp, Artificial Sequence
  sgRNA
  Slc22a2_11
acgagctctgttctctacca

SEQ ID NO: 54693 - DNA, 20 bp, Artificial Sequence
  sgRNA
  Slc22a2_12
tattgctacctgagaccaaa

SEQ ID NO: 54694 - DNA, 20 bp, Artificial Sequence
  sgRNA
  Slc22a2_13
cgtatgtttccttatctgag

SEQ ID NO: 54695 - DNA, 20 bp, Artificial Sequence
  sgRNA
  Slc22a2_14
gctacctgagaccaaaggga

SEQ ID NO: 54696 - DNA, 20 bp, Artificial Sequence
  sgRNA
  Slc22a2_15
tgatgaggatggtgaccaag

SEQ ID NO: 54697 - DNA, 20 bp, Artificial Sequence
  sgRNA
  Slc22a2_16
catcttctcagcatcctcga

SEQ ID NO: 54698 - DNA, 20 bp, Artificial Sequence
  sgRNA
  Slc22a2_17
catgcacatgggcctcgcag

SEQ ID NO: 54699 - DNA, 20 bp, Artificial Sequence
  sgRNA
  Slc22a2_18
tcatcattctcaccatagac

SEQ ID NO: 54700 - DNA, 20 bp, Artificial Sequence
  sgRNA
  Slc22a2_19
accatatttgacacagccca

SEQ ID NO: 54701 - DNA, 20 bp, Artificial Sequence
  sgRNA
  Slc22a2_20
tttcagtcattagtgaacgt

SEQ ID NO: 54702 - DNA, 20 bp, Artificial Sequence
  sgRNA
  Slc22a21_1
gggacatatatccaactacg

SEQ ID NO: 54703 - DNA, 20 bp, Artificial Sequence
  sgRNA
  Slc22a21_2
acaacccagtaaagccattg

SEQ ID NO: 54704 - DNA, 20 bp, Artificial Sequence
  sgRNA
  Slc22a21_3
ttcggaccagatcataaatg

SEQ ID NO: 54705 - DNA, 20 bp, Artificial Sequence
  sgRNA
  Slc22a21_4
gaagctgaatccggtgtgca

SEQ ID NO: 54706 - DNA, 20 bp, Artificial Sequence
  sgRNA
  Slc22a21_5
tgaggatataaggtaggcgg

SEQ ID NO: 54707 - DNA, 20 bp, Artificial Sequence
  sgRNA
  Slc22a21_6
gttgtcagccgtgttcctga

SEQ ID NO: 54708 - DNA, 20 bp, Artificial Sequence
  sgRNA
  Slc22a21_7
tttaggttcggaggttcggg

SEQ ID NO: 54709 - DNA, 20 bp, Artificial Sequence
  sgRNA
  Slc22a21_8
atcccgatggagacgaagga

SEQ ID NO: 54710 - DNA, 20 bp, Artificial Sequence
  sgRNA
  Slc22a21_9
catacttcatcagagagtgg

SEQ ID NO: 54711 - DNA, 20 bp, Artificial Sequence
  sgRNA
  Slc22a21_10
ggatggttagacttcccatg

SEQ ID NO: 54712 - DNA, 20 bp, Artificial Sequence
  sgRNA
  Slc22a21_11
tcatccccaatggctttact

SEQ ID NO: 54713 - DNA, 20 bp, Artificial Sequence
  sgRNA
  Slc22a21_12
aaccagccatagaataacgc

SEQ ID NO: 54714 - DNA, 20 bp, Artificial Sequence
  sgRNA
  Slc22a21_13
cagtatcccgatggagacga

SEQ ID NO: 54715 - DNA, 20 bp, Artificial Sequence
  sgRNA
  Slc22a21_14
gcgcaaccacagtatcccga

SEQ ID NO: 54716 - DNA, 20 bp, Artificial Sequence
  sgRNA
  Slc22a21_15
gcaccagttgtactaagaga

SEQ ID NO: 54717 - DNA, 20 bp, Artificial Sequence
  sgRNA
  Slc22a21_16
tcccgaacctccgaacctaa

SEQ ID NO: 54718 - DNA, 20 bp, Artificial Sequence
  sgRNA
  Slc22a21_17
ccatgaggatataaggtagg

SEQ ID NO: 54719 - DNA, 20 bp, Artificial Sequence
  sgRNA
  Slc22a21_18
tctactaccctggtgatggt

SEQ ID NO: 54720 - DNA, 20 bp, Artificial Sequence
  sgRNA
  Slc22a21_19
tgtgtcccggcgttattcta

SEQ ID NO: 54721 - DNA, 20 bp, Artificial Sequence
  sgRNA
  Slc22a21_20
accagccatagaataacgcc

SEQ ID NO: 54722 - DNA, 20 bp, Artificial Sequence
  sgRNA
  Slc22a23_1
gcccgatttctggtgccgcg

SEQ ID NO: 54723 - DNA, 20 bp, Artificial Sequence
  sgRNA
  Slc22a23_2
tcgagaaagagctttcacgg

SEQ ID NO: 54724 - DNA, 20 bp, Artificial Sequence
  sgRNA
  Slc22a23_3
aaattgcgactgccacgcgt

SEQ ID NO: 54725 - DNA, 20 bp, Artificial Sequence
  sgRNA
  Slc22a23_4
aaaacggttcataattacca

SEQ ID NO: 54726 - DNA, 20 bp, Artificial Sequence
  sgRNA
  Slc22a23_5
ggatgccgtagtcccacgcg

SEQ ID NO: 54727 - DNA, 20 bp, Artificial Sequence
  sgRNA
  Slc22a23_6
gcccatgtcaccccatcggc

SEQ ID NO: 54728 - DNA, 20 bp, Artificial Sequence
  sgRNA
  Slc22a23_7
ctacgctgactactacacca

SEQ ID NO: 54729 - DNA, 20 bp, Artificial Sequence
  sgRNA
  Slc22a23_8
cgggccagttcctcatgccg

SEQ ID NO: 54730 - DNA, 20 bp, Artificial Sequence
  sgRNA
  Slc22a23_9
gatccaggtgagcaccacca

SEQ ID NO: 54731 - DNA, 20 bp, Artificial Sequence
  sgRNA
  Slc22a23_10
gttgctcgtggtcccccagg

SEQ ID NO: 54732 - DNA, 20 bp, Artificial Sequence
  sgRNA
  Slc22a23_11
gcctgagaatatcgccaacg

SEQ ID NO: 54733 - DNA, 20 bp, Artificial Sequence
  sgRNA
  Slc22a23_12
gggcaattggaccagcccct

SEQ ID NO: 54734 - DNA, 20 bp, Artificial Sequence
  sgRNA
  Slc22a23_13
gcgtagaagttctccaggag

SEQ ID NO: 54735 - DNA, 20 bp, Artificial Sequence
  sgRNA
  Slc22a23_14
tgactaccagacacatggct

SEQ ID NO: 54736 - DNA, 20 bp, Artificial Sequence
  sgRNA
  Slc22a23_15
catcgtagtccagcaacagg

SEQ ID NO: 54737 - DNA, 20 bp, Artificial Sequence
  sgRNA
  Slc22a23_16
gctaagttctccttactggt

SEQ ID NO: 54738 - DNA, 20 bp, Artificial Sequence
  sgRNA
  Slc22a23_17
gtaaggagaacttagcgata

SEQ ID NO: 54739 - DNA, 20 bp, Artificial Sequence
  sgRNA
  Slc22a23_18
agttcttctgagtaaggtac

SEQ ID NO: 54740 - DNA, 20 bp, Artificial Sequence
  sgRNA
  Slc22a23_19
actgaggctccccaccgcat

SEQ ID NO: 54741 - DNA, 20 bp, Artificial Sequence
  sgRNA
  Slc22a23_20
aatgtttgcatcccatgcgg

SEQ ID NO: 54742 - DNA, 20 bp, Artificial Sequence
  sgRNA
  Slc22a26_1
atgagaactcattgacagtg

SEQ ID NO: 54743 - DNA, 20 bp, Artificial Sequence
  sgRNA
  Slc22a26_2
tggaacaagtcacgtagaga

SEQ ID NO: 54744 - DNA, 20 bp, Artificial Sequence
  sgRNA
  Slc22a26_3
ccaactctaataataacagt

SEQ ID NO: 54745 - DNA, 20 bp, Artificial Sequence
  sgRNA
  Slc22a26_4
atggctgggtgtatgaccag

SEQ ID NO: 54746 - DNA, 20 bp, Artificial Sequence
  sgRNA
  Slc22a26_5
gcaacagcattaggagtcat

SEQ ID NO: 54747 - DNA, 20 bp, Artificial Sequence
  sgRNA
  Slc22a26_6
ctacaaatatcacctactgt

SEQ ID NO: 54748 - DNA, 20 bp, Artificial Sequence
  sgRNA
  Slc22a26_7
ggagtcattggaatttgtgg

SEQ ID NO: 54749 - DNA, 20 bp, Artificial Sequence
  sgRNA
  Slc22a26_8
gcctcaggttggaatccagt

SEQ ID NO: 54750 - DNA, 20 bp, Artificial Sequence
  sgRNA
  Slc22a26_9
aggactccatagatgatcca

SEQ ID NO: 54751 - DNA, 20 bp, Artificial Sequence
  sgRNA
  Slc22a26_10
gctcctgagatccacacacc

SEQ ID NO: 54752 - DNA, 20 bp, Artificial Sequence
  sgRNA
  Slc22a26_11
gcaagagttgacttattcta

SEQ ID NO: 54753 - DNA, 20 bp, Artificial Sequence
  sgRNA
  Slc22a26_12
ggctgacagaatcagctcgg

SEQ ID NO: 54754 - DNA, 20 bp, Artificial Sequence
  sgRNA
  Slc22a26_13
tgaatctagttggaagccat

SEQ ID NO: 54755 - DNA, 20 bp, Artificial Sequence
  sgRNA
  Slc22a26_14
gatcataataaggggagaca

SEQ ID NO: 54756 - DNA, 20 bp, Artificial Sequence
  sgRNA
  Slc22a26_15
ggtggctgacagaatcagct

SEQ ID NO: 54757 - DNA, 20 bp, Artificial Sequence
  sgRNA
  Slc22a26_16
tcttggatggagtcaggcag

SEQ ID NO: 54758 - DNA, 20 bp, Artificial Sequence
  sgRNA
  Slc22a26_17
ccatccaagatgtagaatgt

SEQ ID NO: 54759 - DNA, 20 bp, Artificial Sequence
  sgRNA
  Slc22a26_18
ttgtcttgcttatacccaca

SEQ ID NO: 54760 - DNA, 20 bp, Artificial Sequence
  sgRNA
  Slc22a26_19
gaacccagcagcgatgacca

SEQ ID NO: 54761 - DNA, 20 bp, Artificial Sequence
  sgRNA
  Slc22a26_20
ttcatgttgatccctacagt

SEQ ID NO: 54762 - DNA, 20 bp, Artificial Sequence
  sgRNA
  Slc22a27_1
tccccctggattccaacctg

SEQ ID NO: 54763 - DNA, 20 bp, Artificial Sequence
  sgRNA
  Slc22a27_2
tgtggtacctcatattgcaa

SEQ ID NO: 54764 - DNA, 20 bp, Artificial Sequence
  sgRNA
  Slc22a27_3
atacacccaaccatccacac

SEQ ID NO: 54765 - DNA, 20 bp, Artificial Sequence
  sgRNA
  Slc22a27_4
gttccacagacaatcctgcc

SEQ ID NO: 54766 - DNA, 20 bp, Artificial Sequence
  sgRNA
  Slc22a27_5
gcttacgtaggatagatgta

SEQ ID NO: 54767 - DNA, 20 bp, Artificial Sequence
  sgRNA
  Slc22a27_6
catactatgccaacatgccc

SEQ ID NO: 54768 - DNA, 20 bp, Artificial Sequence
  sgRNA
  Slc22a27_7
gtcgctagcagcataaacag

SEQ ID NO: 54769 - DNA, 20 bp, Artificial Sequence
  sgRNA
  Slc22a27_8
gcctcaggttggaatccagg

SEQ ID NO: 54770 - DNA, 20 bp, Artificial Sequence
  sgRNA
  Slc22a27_9
atcccatcattaaagtcacg

SEQ ID NO: 54771 - DNA, 20 bp, Artificial Sequence
  sgRNA
  Slc22a27_10
tcgctagcagcataaacagg

SEQ ID NO: 54772 - DNA, 20 bp, Artificial Sequence
  sgRNA
  Slc22a27_11
agtgacagaattcagtgcct

SEQ ID NO: 54773 - DNA, 20 bp, Artificial Sequence
  sgRNA
  Slc22a27_12
atacatctatcctacgtaag

SEQ ID NO: 54774 - DNA, 20 bp, Artificial Sequence
  sgRNA
  Slc22a27_13
aagtgactatttactaatat

SEQ ID NO: 54775 - DNA, 20 bp, Artificial Sequence
  sgRNA
  Slc22a27_14
tgtcgctagcagcataaaca

SEQ ID NO: 54776 - DNA, 20 bp, Artificial Sequence
  sgRNA
  Slc22a27_15
tgcaatatgaggtaccacaa

SEQ ID NO: 54777 - DNA, 20 bp, Artificial Sequence
  sgRNA
  Slc22a27_16
attggatacatgatatcagc

SEQ ID NO: 54778 - DNA, 20 bp, Artificial Sequence
  sgRNA
  Slc22a27_17
gtaaaagaaaaactatctga

SEQ ID NO: 54779 - DNA, 20 bp, Artificial Sequence
  sgRNA
  Slc22a27_18
atagaagatccagggcatgt

SEQ ID NO: 54780 - DNA, 20 bp, Artificial Sequence
  sgRNA
  Slc22a27_19
gtaggagtcattgggttctt

SEQ ID NO: 54781 - DNA, 20 bp, Artificial Sequence
  sgRNA
  Slc22a27_20
attcctggcaggattgtctg

SEQ ID NO: 54782 - DNA, 20 bp, Artificial Sequence
  sgRNA
  Slc22a28_1
ttgtaatatgaggtaccaca

SEQ ID NO: 54783 - DNA, 20 bp, Artificial Sequence
  sgRNA
  Slc22a28_2
tggaaataccctaaccatgg

SEQ ID NO: 54784 - DNA, 20 bp, Artificial Sequence
  sgRNA
  Slc22a28_3
atgacttacctcagtcacaa

SEQ ID NO: 54785 - DNA, 20 bp, Artificial Sequence
  sgRNA
  Slc22a28_4
ggtggatgtcagagtcagct

SEQ ID NO: 54786 - DNA, 20 bp, Artificial Sequence
  sgRNA
  Slc22a28_5
gtactaatattatcctgttg

SEQ ID NO: 54787 - DNA, 20 bp, Artificial Sequence
  sgRNA
  Slc22a28_6
tgtgaccacaataatacgca

SEQ ID NO: 54788 - DNA, 20 bp, Artificial Sequence
  sgRNA
  Slc22a28_7
gcgtattattgtggtcacat

SEQ ID NO: 54789 - DNA, 20 bp, Artificial Sequence
  sgRNA
  Slc22a28_8
ggatgtcagagtcagctcgg

SEQ ID NO: 54790 - DNA, 20 bp, Artificial Sequence
  sgRNA
  Slc22a28_9
acacacccatcttacgaaat

SEQ ID NO: 54791 - DNA, 20 bp, Artificial Sequence
  sgRNA
  Slc22a28_10
gcaacaggtatgggagtcat

SEQ ID NO: 54792 - DNA, 20 bp, Artificial Sequence
  sgRNA
  Slc22a28_11
cactactgagaaaccgcaac

SEQ ID NO: 54793 - DNA, 20 bp, Artificial Sequence
  sgRNA
  Slc22a28_12
gggacgtagaataacccagc

SEQ ID NO: 54794 - DNA, 20 bp, Artificial Sequence
  sgRNA
  Slc22a28_13
gaaagactcaagacaagcaa

SEQ ID NO: 54795 - DNA, 20 bp, Artificial Sequence
  sgRNA
  Slc22a28_14
atgtgaccacaataatacgc

SEQ ID NO: 54796 - DNA, 20 bp, Artificial Sequence
  sgRNA
  Slc22a28_15
catatccgatttcgtaagat

SEQ ID NO: 54797 - DNA, 20 bp, Artificial Sequence
  sgRNA
  Slc22a28_16
cagggacatgagaaccagct

SEQ ID NO: 54798 - DNA, 20 bp, Artificial Sequence
  sgRNA
  Slc22a28_17
attggatacatgatattggc

SEQ ID NO: 54799 - DNA, 20 bp, Artificial Sequence
  sgRNA
  Slc22a28_18
tcagggacatgagaaccagc

SEQ ID NO: 54800 - DNA, 20 bp, Artificial Sequence
  sgRNA
  Slc22a28_19
tcaacatgaagattcccctc

SEQ ID NO: 54801 - DNA, 20 bp, Artificial Sequence
  sgRNA
  Slc22a28_20
ctcaagacaagcaaaggagg

SEQ ID NO: 54802 - DNA, 20 bp, Artificial Sequence
  sgRNA
  Slc22a29_1
atacatccatcctacgtaag

SEQ ID NO: 54803 - DNA, 20 bp, Artificial Sequence
  sgRNA
  Slc22a29_2
tccaatatgtggtactacaa

SEQ ID NO: 54804 - DNA, 20 bp, Artificial Sequence
  sgRNA
  Slc22a29_3
gaattctggagacctaacca

SEQ ID NO: 54805 - DNA, 20 bp, Artificial Sequence
  sgRNA
  Slc22a29_4
aaagcactgccatcatggct

SEQ ID NO: 54806 - DNA, 20 bp, Artificial Sequence
  sgRNA
  Slc22a29_5
gtcgctaccagcataaacag

SEQ ID NO: 54807 - DNA, 20 bp, Artificial Sequence
  sgRNA
  Slc22a29_6
gccattgtagtaccacatat

SEQ ID NO: 54808 - DNA, 20 bp, Artificial Sequence
  sgRNA
  Slc22a29_7
tcgctaccagcataaacagg

SEQ ID NO: 54809 - DNA, 20 bp, Artificial Sequence
  sgRNA
  Slc22a29_8
gtactacaatggcattgagg

SEQ ID NO: 54810 - DNA, 20 bp, Artificial Sequence
  sgRNA
  Slc22a29_9
acatatccgcttacgtagga

SEQ ID NO: 54811 - DNA, 20 bp, Artificial Sequence
  sgRNA
  Slc22a29_10
gcgcagacattgtcagctgg

SEQ ID NO: 54812 - DNA, 20 bp, Artificial Sequence
  sgRNA
  Slc22a29_11
catactatgccaacttgccc

SEQ ID NO: 54813 - DNA, 20 bp, Artificial Sequence
  sgRNA
  Slc22a29_12
ggaatttcttctctatgtgt

SEQ ID NO: 54814 - DNA, 20 bp, Artificial Sequence
  sgRNA
  Slc22a29_13
atcccatcattaaagtcaca

SEQ ID NO: 54815 - DNA, 20 bp, Artificial Sequence
  sgRNA
  Slc22a29_14
attatggccacattggcagg

SEQ ID NO: 54816 - DNA, 20 bp, Artificial Sequence
  sgRNA
  Slc22a29_15
tgtagtaccacatattggaa

SEQ ID NO: 54817 - DNA, 20 bp, Artificial Sequence
  sgRNA
  Slc22a29_16
gcttacgtaggatggatgta

SEQ ID NO: 54818 - DNA, 20 bp, Artificial Sequence
  sgRNA
  Slc22a29_17
gcaacagctctaggagtcat

SEQ ID NO: 54819 - DNA, 20 bp, Artificial Sequence
  sgRNA
  Slc22a29_18
atgtcgctaccagcataaac

SEQ ID NO: 54820 - DNA, 20 bp, Artificial Sequence
  sgRNA
  Slc22a29_19
tatcctactgccattatcag

SEQ ID NO: 54821 - DNA, 20 bp, Artificial Sequence
  sgRNA
  Slc22a29_20
aggaatttcttctctatgtg

SEQ ID NO: 54822 - DNA, 20 bp, Artificial Sequence
  sgRNA
  Slc22a3_1
aggacaccagaggcgcggag

SEQ ID NO: 54823 - DNA, 20 bp, Artificial Sequence
  sgRNA
  Slc22a3_2
aggaagaataatgatcccga

SEQ ID NO: 54824 - DNA, 20 bp, Artificial Sequence
  sgRNA
  Slc22a3_3
cctctcatcaaattactcag

SEQ ID NO: 54825 - DNA, 20 bp, Artificial Sequence
  sgRNA
  Slc22a3_4
cccattaccagtaatagagg

SEQ ID NO: 54826 - DNA, 20 bp, Artificial Sequence
  sgRNA
  Slc22a3_5
ggttattcctagtcttccca

SEQ ID NO: 54827 - DNA, 20 bp, Artificial Sequence
  sgRNA
  Slc22a3_6
ggaagaccacaccgacgaag

SEQ ID NO: 54828 - DNA, 20 bp, Artificial Sequence
  sgRNA
  Slc22a3_7
gcgagttcgggcgcttccag

SEQ ID NO: 54829 - DNA, 20 bp, Artificial Sequence
  sgRNA
  Slc22a3_8
gacaagtccttggtacacca

SEQ ID NO: 54830 - DNA, 20 bp, Artificial Sequence
  sgRNA
  Slc22a3_9
cagccgaaagagcagaaacg

SEQ ID NO: 54831 - DNA, 20 bp, Artificial Sequence
  sgRNA
  Slc22a3_10
gcagccagcccgactactat

SEQ ID NO: 54832 - DNA, 20 bp, Artificial Sequence
  sgRNA
  Slc22a3_11
ataaacaatttcgaaggcca

SEQ ID NO: 54833 - DNA, 20 bp, Artificial Sequence
  sgRNA
  Slc22a3_12
tcaccgctgcaggacaccag

SEQ ID NO: 54834 - DNA, 20 bp, Artificial Sequence
  sgRNA
  Slc22a3_13
agttcacagttgcatcagtg

SEQ ID NO: 54835 - DNA, 20 bp, Artificial Sequence
  sgRNA
  Slc22a3_14
cccgcgacaccaatagtagt

SEQ ID NO: 54836 - DNA, 20 bp, Artificial Sequence
  sgRNA
  Slc22a3_15
gctgcaggacaccagaggcg

SEQ ID NO: 54837 - DNA, 20 bp, Artificial Sequence
  sgRNA
  Slc22a3_16
agttgtacccaacgacatta

SEQ ID NO: 54838 - DNA, 20 bp, Artificial Sequence
  sgRNA
  Slc22a3_17
tattgcttgccgcaaaggga

SEQ ID NO: 54839 - DNA, 20 bp, Artificial Sequence
  sgRNA
  Slc22a3_18
ggcaagcaatatagtggcag

SEQ ID NO: 54840 - DNA, 20 bp, Artificial Sequence
  sgRNA
  Slc22a3_19
gggaagactaggaataacca

SEQ ID NO: 54841 - DNA, 20 bp, Artificial Sequence
  sgRNA
  Slc22a3_20
ccactgccaccgctacctgc

SEQ ID NO: 54842 - DNA, 20 bp, Artificial Sequence
  sgRNA
  Slc22a30_1
ggatgtcagagtcggctcgg

SEQ ID NO: 54843 - DNA, 20 bp, Artificial Sequence
  sgRNA
  Slc22a30_2
acacacccatcttacgaaag

SEQ ID NO: 54844 - DNA, 20 bp, Artificial Sequence
  sgRNA
  Slc22a30_3
tgtggtacctcatattacaa

SEQ ID NO: 54845 - DNA, 20 bp, Artificial Sequence
  sgRNA
  Slc22a30_4
gtgcctgagattcacacacc

SEQ ID NO: 54846 - DNA, 20 bp, Artificial Sequence
  sgRNA
  Slc22a30_5
gtcaagacaagcaaaggagg

SEQ ID NO: 54847 - DNA, 20 bp, Artificial Sequence
  sgRNA
  Slc22a30_6
gaaagagtcaagacaagcaa

SEQ ID NO: 54848 - DNA, 20 bp, Artificial Sequence
  sgRNA
  Slc22a30_7
gctttcgtaagatgggtgtg

SEQ ID NO: 54849 - DNA, 20 bp, Artificial Sequence
  sgRNA
  Slc22a30_8
catatccgctttcgtaagat

SEQ ID NO: 54850 - DNA, 20 bp, Artificial Sequence
  sgRNA
  Slc22a30_9
tcaacatgaatattcccctc

SEQ ID NO: 54851 - DNA, 20 bp, Artificial Sequence
  sgRNA
  Slc22a30_10
ggtggatgtcagagtcggct

SEQ ID NO: 54852 - DNA, 20 bp, Artificial Sequence
  sgRNA
  Slc22a30_11
atcggatacatgatattggc

SEQ ID NO: 54853 - DNA, 20 bp, Artificial Sequence
  sgRNA
  Slc22a30_12
cactactgagaaactgcaac

SEQ ID NO: 54854 - DNA, 20 bp, Artificial Sequence
  sgRNA
  Slc22a30_13
agagtcaagacaagcaaagg

SEQ ID NO: 54855 - DNA, 20 bp, Artificial Sequence
  sgRNA
  Slc22a30_14
atgggagtcattgcaatgtt

SEQ ID NO: 54856 - DNA, 20 bp, Artificial Sequence
  sgRNA
  Slc22a30_15
gggacgtagaataactcagc

SEQ ID NO: 54857 - DNA, 20 bp, Artificial Sequence
  sgRNA
  Slc22a30_16
gcagtttctcagtagtgcat

SEQ ID NO: 54858 - DNA, 20 bp, Artificial Sequence
  sgRNA
  Slc22a30_17
caacatgaatattcccctca

SEQ ID NO: 54859 - DNA, 20 bp, Artificial Sequence
  sgRNA
  Slc22a30_18
acatatccgctttcgtaaga

SEQ ID NO: 54860 - DNA, 20 bp, Artificial Sequence
  sgRNA
  Slc22a30_19
tggacaagccctaaattcct

SEQ ID NO: 54861 - DNA, 20 bp, Artificial Sequence
  sgRNA
  Slc22a30_20
agaaagtgctgctgccaatg

SEQ ID NO: 54862 - DNA, 20 bp, Artificial Sequence
  sgRNA
  Slc22a4_1
cagagcaaagtaacccactg

SEQ ID NO: 54863 - DNA, 20 bp, Artificial Sequence
  sgRNA
  Slc22a4_2
gagaacgcctacgaagaaca

SEQ ID NO: 54864 - DNA, 20 bp, Artificial Sequence
  sgRNA
  Slc22a4_3
cgcaaagatgaacagcatcg

SEQ ID NO: 54865 - DNA, 20 bp, Artificial Sequence
  sgRNA
  Slc22a4_4
aaccaggcaacggtgctcgg

SEQ ID NO: 54866 - DNA, 20 bp, Artificial Sequence
  sgRNA
  Slc22a4_5
ccagatctccaactacgtgg

SEQ ID NO: 54867 - DNA, 20 bp, Artificial Sequence
  sgRNA
  Slc22a4_6
ttattccagaatctccccgg

SEQ ID NO: 54868 - DNA, 20 bp, Artificial Sequence
  sgRNA
  Slc22a4_7
ccagctataatatatctccg

SEQ ID NO: 54869 - DNA, 20 bp, Artificial Sequence
  sgRNA
  Slc22a4_8
gcgcaaccacagcatcccct

SEQ ID NO: 54870 - DNA, 20 bp, Artificial Sequence
  sgRNA
  Slc22a4_9
catcgcagagaagttggcga

SEQ ID NO: 54871 - DNA, 20 bp, Artificial Sequence
  sgRNA
  Slc22a4_10
ggacagtcagactgcccatg

SEQ ID NO: 54872 - DNA, 20 bp, Artificial Sequence
  sgRNA
  Slc22a4_11
acagcatcgtggcgccagca

SEQ ID NO: 54873 - DNA, 20 bp, Artificial Sequence
  sgRNA
  Slc22a4_12
aatgatgctgcccacccgag

SEQ ID NO: 54874 - DNA, 20 bp, Artificial Sequence
  sgRNA
  Slc22a4_13
gcacagccatggttgcaaag

SEQ ID NO: 54875 - DNA, 20 bp, Artificial Sequence
  sgRNA
  Slc22a4_14
tgaagtatgcaaacagcggc

SEQ ID NO: 54876 - DNA, 20 bp, Artificial Sequence
  sgRNA
  Slc22a4_15
tgtgcttctcttgatccaag

SEQ ID NO: 54877 - DNA, 20 bp, Artificial Sequence
  sgRNA
  Slc22a4_16
tgctactgcgaaccctgcca

SEQ ID NO: 54878 - DNA, 20 bp, Artificial Sequence
  sgRNA
  Slc22a4_17
agtaagctggaacttcaatc

SEQ ID NO: 54879 - DNA, 20 bp, Artificial Sequence
  sgRNA
  Slc22a4_18
gccccctatttcgtttacct

SEQ ID NO: 54880 - DNA, 20 bp, Artificial Sequence
  sgRNA
  Slc22a4_19
gaatccagtctgcacagcca

SEQ ID NO: 54881 - DNA, 20 bp, Artificial Sequence
  sgRNA
  Slc22a4_20
agactgcccatgaggatgta

SEQ ID NO: 54882 - DNA, 20 bp, Artificial Sequence
  sgRNA
  Slc22a5_1
tttatgatctgatccgaaca

SEQ ID NO: 54883 - DNA, 20 bp, Artificial Sequence
  sgRNA
  Slc22a5_2
gggtcagatctccaactacg

SEQ ID NO: 54884 - DNA, 20 bp, Artificial Sequence
  sgRNA
  Slc22a5_3
cacaaggcaacggtgctccg

SEQ ID NO: 54885 - DNA, 20 bp, Artificial Sequence
  sgRNA
  Slc22a5_4
cacacccacgaaaaacaagg

SEQ ID NO: 54886 - DNA, 20 bp, Artificial Sequence
  sgRNA
  Slc22a5_5
gccgagatagaatatcgccg

SEQ ID NO: 54887 - DNA, 20 bp, Artificial Sequence
  sgRNA
  Slc22a5_6
tgctggcgctcactgtgcca

SEQ ID NO: 54888 - DNA, 20 bp, Artificial Sequence
  sgRNA
  Slc22a5_7
ggtccccgccaggaacacga

SEQ ID NO: 54889 - DNA, 20 bp, Artificial Sequence
  sgRNA
  Slc22a5_8
agttcacagagaagacctgc

SEQ ID NO: 54890 - DNA, 20 bp, Artificial Sequence
  sgRNA
  Slc22a5_9
gcgcaaccacagtatcccgt

SEQ ID NO: 54891 - DNA, 20 bp, Artificial Sequence
  sgRNA
  Slc22a5_10
gatccgaacacggaatatca

SEQ ID NO: 54892 - DNA, 20 bp, Artificial Sequence
  sgRNA
  Slc22a5_11
tatgtccatcgtgttcctgg

SEQ ID NO: 54893 - DNA, 20 bp, Artificial Sequence
  sgRNA
  Slc22a5_12
tgacactcctaacttgcatg

SEQ ID NO: 54894 - DNA, 20 bp, Artificial Sequence
  sgRNA
  Slc22a5_13
ttcccatgagaatataaggc

SEQ ID NO: 54895 - DNA, 20 bp, Artificial Sequence
  sgRNA
  Slc22a5_14
cggtgtgaggcacaaggcaa

SEQ ID NO: 54896 - DNA, 20 bp, Artificial Sequence
  sgRNA
  Slc22a5_15
cagccgagatagaatatcgc

SEQ ID NO: 54897 - DNA, 20 bp, Artificial Sequence
  sgRNA
  Slc22a5_16
ataaggcaggaagcgatcat

SEQ ID NO: 54898 - DNA, 20 bp, Artificial Sequence
  sgRNA
  Slc22a5_17
gctggcgctcactgtgccag

SEQ ID NO: 54899 - DNA, 20 bp, Artificial Sequence
  sgRNA
  Slc22a5_18
ttgacactcctaacttgcat

SEQ ID NO: 54900 - DNA, 20 bp, Artificial Sequence
  sgRNA
  Slc22a5_19
gacactgccacccaggaaaa

SEQ ID NO: 54901 - DNA, 20 bp, Artificial Sequence
  sgRNA
  Slc22a5_20
tgttgttgcagtacttgccc

SEQ ID NO: 54902 - DNA, 20 bp, Artificial Sequence
  sgRNA
  Slc22a6_1
aaggaactgactctaaacaa

SEQ ID NO: 54903 - DNA, 20 bp, Artificial Sequence
  sgRNA
  Slc22a6_2
attcacacccgtgcctatgt

SEQ ID NO: 54904 - DNA, 20 bp, Artificial Sequence
  sgRNA
  Slc22a6_3
tcttcattgagtcagcccgc

SEQ ID NO: 54905 - DNA, 20 bp, Artificial Sequence
  sgRNA
  Slc22a6_4
cccgtagtaggcaaagctag

SEQ ID NO: 54906 - DNA, 20 bp, Artificial Sequence
  sgRNA
  Slc22a6_5
gtgaatggcataataccgag

SEQ ID NO: 54907 - DNA, 20 bp, Artificial Sequence
  sgRNA
  Slc22a6_6
tagtgaatggcataataccg

SEQ ID NO: 54908 - DNA, 20 bp, Artificial Sequence
  sgRNA
  Slc22a6_7
tcaagatcagcaccttccga

SEQ ID NO: 54909 - DNA, 20 bp, Artificial Sequence
  sgRNA
  Slc22a6_8
acagcgccgaagatgaagag

SEQ ID NO: 54910 - DNA, 20 bp, Artificial Sequence
  sgRNA
  Slc22a6_9
cataggcgataccagccagg

SEQ ID NO: 54911 - DNA, 20 bp, Artificial Sequence
  sgRNA
  Slc22a6_10
ggtcgtccttgcttgtccag

SEQ ID NO: 54912 - DNA, 20 bp, Artificial Sequence
  sgRNA
  Slc22a6_11
ccagctgatccaggtcacca

SEQ ID NO: 54913 - DNA, 20 bp, Artificial Sequence
  sgRNA
  Slc22a6_12
ggttggcattagcaggtggg

SEQ ID NO: 54914 - DNA, 20 bp, Artificial Sequence
  sgRNA
  Slc22a6_13
gggtcgtccttgcttgtcca

SEQ ID NO: 54915 - DNA, 20 bp, Artificial Sequence
  sgRNA
  Slc22a6_14
aactgcatcttcctgtacac

SEQ ID NO: 54916 - DNA, 20 bp, Artificial Sequence
  sgRNA
  Slc22a6_15
gatgcgggccactctctgca

SEQ ID NO: 54917 - DNA, 20 bp, Artificial Sequence
  sgRNA
  Slc22a6_16
ggaagaggcgccgaagcgtg

SEQ ID NO: 54918 - DNA, 20 bp, Artificial Sequence
  sgRNA
  Slc22a6_17
gcgcagcagctccatggcgg

SEQ ID NO: 54919 - DNA, 20 bp, Artificial Sequence
  sgRNA
  Slc22a6_18
gcctttccctagtacagcca

SEQ ID NO: 54920 - DNA, 20 bp, Artificial Sequence
  sgRNA
  Slc22a6_19
tgacctcctgaaacaggtgg

SEQ ID NO: 54921 - DNA, 20 bp, Artificial Sequence
  sgRNA
  Slc22a6_20
gcccaaggtctctggcagca

SEQ ID NO: 54922 - DNA, 20 bp, Artificial Sequence
  sgRNA
  Slc22a7_1
cggaacaggtctaagtacga

SEQ ID NO: 54923 - DNA, 20 bp, Artificial Sequence
  sgRNA
  Slc22a7_2
ccgtatcaggtacccaacca

SEQ ID NO: 54924 - DNA, 20 bp, Artificial Sequence
  sgRNA
  Slc22a7_3
gagcctggggataggcaaag

SEQ ID NO: 54925 - DNA, 20 bp, Artificial Sequence
  sgRNA
  Slc22a7_4
tgcatcgggagcaggaatcg

SEQ ID NO: 54926 - DNA, 20 bp, Artificial Sequence
  sgRNA
  Slc22a7_5
gattcactgcactcataggc

SEQ ID NO: 54927 - DNA, 20 bp, Artificial Sequence
  sgRNA
  Slc22a7_6
aagctgccgtcagtctcccg

SEQ ID NO: 54928 - DNA, 20 bp, Artificial Sequence
  sgRNA
  Slc22a7_7
cgtgggacgccgcctcacag

SEQ ID NO: 54929 - DNA, 20 bp, Artificial Sequence
  sgRNA
  Slc22a7_8
gcacgatggcttctaaccca

SEQ ID NO: 54930 - DNA, 20 bp, Artificial Sequence
  sgRNA
  Slc22a7_9
catccagcaagaccaccagt

SEQ ID NO: 54931 - DNA, 20 bp, Artificial Sequence
  sgRNA
  Slc22a7_10
ggaggtgccttccaaaatta

SEQ ID NO: 54932 - DNA, 20 bp, Artificial Sequence
  sgRNA
  Slc22a7_11
aaacatgatgtagttgaccg

SEQ ID NO: 54933 - DNA, 20 bp, Artificial Sequence
  sgRNA
  Slc22a7_12
tgagccggtgagcatgcggg

SEQ ID NO: 54934 - DNA, 20 bp, Artificial Sequence
  sgRNA
  Slc22a7_13
ggatgtggagcaccgcactg

SEQ ID NO: 54935 - DNA, 20 bp, Artificial Sequence
  sgRNA
  Slc22a7_14
gcagcaccagattccgcagt

SEQ ID NO: 54936 - DNA, 20 bp, Artificial Sequence
  sgRNA
  Slc22a7_15
gcaccaccttctggacagga

SEQ ID NO: 54937 - DNA, 20 bp, Artificial Sequence
  sgRNA
  Slc22a7_16
cacgccgatgaagaagcacg

SEQ ID NO: 54938 - DNA, 20 bp, Artificial Sequence
  sgRNA
  Slc22a7_17
gggtacctgagtctgcacga

SEQ ID NO: 54939 - DNA, 20 bp, Artificial Sequence
  sgRNA
  Slc22a7_18
tctgtgccaagctcaatggg

SEQ ID NO: 54940 - DNA, 20 bp, Artificial Sequence
  sgRNA
  Slc22a7_19
cctggggataggcaaagcgg

SEQ ID NO: 54941 - DNA, 20 bp, Artificial Sequence
  sgRNA
  Slc22a7_20
ggtacaactcagacgtgaac

SEQ ID NO: 54942 - DNA, 20 bp, Artificial Sequence
  sgRNA
  Slc22a8_1
tctgaagacactccaacgtg

SEQ ID NO: 54943 - DNA, 20 bp, Artificial Sequence
  sgRNA
  Slc22a8_2
gatctgtagcaagttgtggt

SEQ ID NO: 54944 - DNA, 20 bp, Artificial Sequence
  sgRNA
  Slc22a8_3
aatgggtacccacctccacg

SEQ ID NO: 54945 - DNA, 20 bp, Artificial Sequence
  sgRNA
  Slc22a8_4
cgtttggcagatgcacgaag

SEQ ID NO: 54946 - DNA, 20 bp, Artificial Sequence
  sgRNA
  Slc22a8_5
agtaacatatgggctcgagt

SEQ ID NO: 54947 - DNA, 20 bp, Artificial Sequence
  sgRNA
  Slc22a8_6
gggaccatgactctactggg

SEQ ID NO: 54948 - DNA, 20 bp, Artificial Sequence
  sgRNA
  Slc22a8_7
aggcagaatgaattgaccaa

SEQ ID NO: 54949 - DNA, 20 bp, Artificial Sequence
  sgRNA
  Slc22a8_8
gcccttaccagaaactatcg

SEQ ID NO: 54950 - DNA, 20 bp, Artificial Sequence
  sgRNA
  Slc22a8_9
agttgtggttggctattccg

SEQ ID NO: 54951 - DNA, 20 bp, Artificial Sequence
  sgRNA
  Slc22a8_10
gcgccactgaggaacggcat

SEQ ID NO: 54952 - DNA, 20 bp, Artificial Sequence
  sgRNA
  Slc22a8_11
tatggactctggtacccacc

SEQ ID NO: 54953 - DNA, 20 bp, Artificial Sequence
  sgRNA
  Slc22a8_12
gtatgggtatcagtaacata

SEQ ID NO: 54954 - DNA, 20 bp, Artificial Sequence
  sgRNA
  Slc22a8_13
gagggtctcaagcagaaaga

SEQ ID NO: 54955 - DNA, 20 bp, Artificial Sequence
  sgRNA
  Slc22a8_14
tgttgatgagatggcccgcg

SEQ ID NO: 54956 - DNA, 20 bp, Artificial Sequence
  sgRNA
  Slc22a8_15
tcctcgatagtttctggtaa

SEQ ID NO: 54957 - DNA, 20 bp, Artificial Sequence
  sgRNA
  Slc22a8_16
gtcttcccaatgacacccag

SEQ ID NO: 54958 - DNA, 20 bp, Artificial Sequence
  sgRNA
  Slc22a8_17
gccccactggtgaaaatcac

SEQ ID NO: 54959 - DNA, 20 bp, Artificial Sequence
  sgRNA
  Slc22a8_18
gcttcccgtttgggcccaag

SEQ ID NO: 54960 - DNA, 20 bp, Artificial Sequence
  sgRNA
  Slc22a8_19
gccatatttgaccttggctg

SEQ ID NO: 54961 - DNA, 20 bp, Artificial Sequence
  sgRNA
  Slc22a8_20
tgatgagatggcccgcgtgg

SEQ ID NO: 54962 - DNA, 20 bp, Artificial Sequence
  sgRNA
  Slc23a1_1
ctggcatcctcgtatccggg

SEQ ID NO: 54963 - DNA, 20 bp, Artificial Sequence
  sgRNA
  Slc23a1_2
acaggcatagtaatcaccga

SEQ ID NO: 54964 - DNA, 20 bp, Artificial Sequence
  sgRNA
  Slc23a1_3
ctcatccagtcccaacattg

SEQ ID NO: 54965 - DNA, 20 bp, Artificial Sequence
  sgRNA
  Slc23a1_4
aggctcgaactgatgcccga

SEQ ID NO: 54966 - DNA, 20 bp, Artificial Sequence
  sgRNA
  Slc23a1_5
tttaccatgcccatcccaaa

SEQ ID NO: 54967 - DNA, 20 bp, Artificial Sequence
  sgRNA
  Slc23a1_6
gcgggcatcattgagtccat

SEQ ID NO: 54968 - DNA, 20 bp, Artificial Sequence
  sgRNA
  Slc23a1_7
gcatctgctgcattatcgct

SEQ ID NO: 54969 - DNA, 20 bp, Artificial Sequence
  sgRNA
  Slc23a1_8
cctgttacctgtttaccgat

SEQ ID NO: 54970 - DNA, 20 bp, Artificial Sequence
  sgRNA
  Slc23a1_9
gcaggtatcatgctaatcct

SEQ ID NO: 54971 - DNA, 20 bp, Artificial Sequence
  sgRNA
  Slc23a1_10
ttactatgcctgtgcccggt

SEQ ID NO: 54972 - DNA, 20 bp, Artificial Sequence
  sgRNA
  Slc23a1_11
atgaggtcgtggattcagca

SEQ ID NO: 54973 - DNA, 20 bp, Artificial Sequence
  sgRNA
  Slc23a1_12
cacgtagcagagcagccaca

SEQ ID NO: 54974 - DNA, 20 bp, Artificial Sequence
  sgRNA
  Slc23a1_13
cctcacactacccaactacc

SEQ ID NO: 54975 - DNA, 20 bp, Artificial Sequence
  sgRNA
  Slc23a1_14
ggtaccatcttcacctgtgt

SEQ ID NO: 54976 - DNA, 20 bp, Artificial Sequence
  sgRNA
  Slc23a1_15
gagagctgtgaatttgccaa

SEQ ID NO: 54977 - DNA, 20 bp, Artificial Sequence
  sgRNA
  Slc23a1_16
tgacgtctcactgttggcgt

SEQ ID NO: 54978 - DNA, 20 bp, Artificial Sequence
  sgRNA
  Slc23a1_17
gtcccaacattggggtccta

SEQ ID NO: 54979 - DNA, 20 bp, Artificial Sequence
  sgRNA
  Slc23a1_18
agagctacgatttccccttt

SEQ ID NO: 54980 - DNA, 20 bp, Artificial Sequence
  sgRNA
  Slc23a1_19
catggtgtccagtatggtgg

SEQ ID NO: 54981 - DNA, 20 bp, Artificial Sequence
  sgRNA
  Slc23a1_20
ggctcgaactgatgcccgag

SEQ ID NO: 54982 - DNA, 20 bp, Artificial Sequence
  sgRNA
  Slc23a2_1
ctggcatccccgaatccaag

SEQ ID NO: 54983 - DNA, 20 bp, Artificial Sequence
  sgRNA
  Slc23a2_2
gtgtttcagtggcacgatcg

SEQ ID NO: 54984 - DNA, 20 bp, Artificial Sequence
  sgRNA
  Slc23a2_3
acaggcgtagtagtcaccga

SEQ ID NO: 54985 - DNA, 20 bp, Artificial Sequence
  sgRNA
  Slc23a2_4
gcgtgcatagtagccatagt

SEQ ID NO: 54986 - DNA, 20 bp, Artificial Sequence
  sgRNA
  Slc23a2_5
tttattgcatggataggcgg

SEQ ID NO: 54987 - DNA, 20 bp, Artificial Sequence
  sgRNA
  Slc23a2_6
gcctcctacaaacatagcgg

SEQ ID NO: 54988 - DNA, 20 bp, Artificial Sequence
  sgRNA
  Slc23a2_7
ttacctccgacaaaaccctc

SEQ ID NO: 54989 - DNA, 20 bp, Artificial Sequence
  sgRNA
  Slc23a2_8
ttaataatgttcatgccaaa

SEQ ID NO: 54990 - DNA, 20 bp, Artificial Sequence
  sgRNA
  Slc23a2_9
cttgaccatcacacccaccg

SEQ ID NO: 54991 - DNA, 20 bp, Artificial Sequence
  sgRNA
  Slc23a2_10
gggtatggaaccttaaacca

SEQ ID NO: 54992 - DNA, 20 bp, Artificial Sequence
  sgRNA
  Slc23a2_11
gtatggaaccttaaaccatg

SEQ ID NO: 54993 - DNA, 20 bp, Artificial Sequence
  sgRNA
  Slc23a2_12
accaccgctatgtttgtagg

SEQ ID NO: 54994 - DNA, 20 bp, Artificial Sequence
  sgRNA
  Slc23a2_13
gctggctgatgccatgtgcg

SEQ ID NO: 54995 - DNA, 20 bp, Artificial Sequence
  sgRNA
  Slc23a2_14
atatacctcagcagagcccc

SEQ ID NO: 54996 - DNA, 20 bp, Artificial Sequence
  sgRNA
  Slc23a2_15
gtgtacttctggtagcccca

SEQ ID NO: 54997 - DNA, 20 bp, Artificial Sequence
  sgRNA
  Slc23a2_16
tcactgatagaagtggtcat

SEQ ID NO: 54998 - DNA, 20 bp, Artificial Sequence
  sgRNA
  Slc23a2_17
acagcctcctacaaacatag

SEQ ID NO: 54999 - DNA, 20 bp, Artificial Sequence
  sgRNA
  Slc23a2_18
cagcggagagcaggacaacg

SEQ ID NO: 55000 - DNA, 20 bp, Artificial Sequence
  sgRNA
  Slc23a2_19
acattgctgcagacaacatt

SEQ ID NO: 55001 - DNA, 20 bp, Artificial Sequence
  sgRNA
  Slc23a2_20
ggctgatgccatgtgcgtgg

SEQ ID NO: 55002 - DNA, 20 bp, Artificial Sequence
  sgRNA
  Slc24a2_1
tcgaagccacgcctccaacg

SEQ ID NO: 55003 - DNA, 20 bp, Artificial Sequence
  sgRNA
  Slc24a2_2
tgagaatgagaggcagaatg

SEQ ID NO: 55004 - DNA, 20 bp, Artificial Sequence
  sgRNA
  Slc24a2_3
ggataacgttatcatgtggt

SEQ ID NO: 55005 - DNA, 20 bp, Artificial Sequence
  sgRNA
  Slc24a2_4
aaagaactcatcacagacga

SEQ ID NO: 55006 - DNA, 20 bp, Artificial Sequence
  sgRNA
  Slc24a2_5
gacgccatcgagcgaagctt

SEQ ID NO: 55007 - DNA, 20 bp, Artificial Sequence
  sgRNA
  Slc24a2_6
ggccaaacatgatgaagccg

SEQ ID NO: 55008 - DNA, 20 bp, Artificial Sequence
  sgRNA
  Slc24a2_7
aagccacgcctccaacgagg

SEQ ID NO: 55009 - DNA, 20 bp, Artificial Sequence
  sgRNA
  Slc24a2_8
gttcatccgccatttgcaga

SEQ ID NO: 55010 - DNA, 20 bp, Artificial Sequence
  sgRNA
  Slc24a2_9
ccatcgccctctgcaaatgg

SEQ ID NO: 55011 - DNA, 20 bp, Artificial Sequence
  sgRNA
  Slc24a2_10
ccaccaggaacacgaagtag

SEQ ID NO: 55012 - DNA, 20 bp, Artificial Sequence
  sgRNA
  Slc24a2_11
gcttcacccatctctctact

SEQ ID NO: 55013 - DNA, 20 bp, Artificial Sequence
  sgRNA
  Slc24a2_12
tgttcatccgccatttgcag

SEQ ID NO: 55014 - DNA, 20 bp, Artificial Sequence
  sgRNA
  Slc24a2_13
aagagacgtgaaaagttctg

SEQ ID NO: 55015 - DNA, 20 bp, Artificial Sequence
  sgRNA
  Slc24a2_14
gggctggtcatcttcttcct

SEQ ID NO: 55016 - DNA, 20 bp, Artificial Sequence
  sgRNA
  Slc24a2_15
acatctttgacatcactgtg

SEQ ID NO: 55017 - DNA, 20 bp, Artificial Sequence
  sgRNA
  Slc24a2_16
gtcggccaggacaagctgag

SEQ ID NO: 55018 - DNA, 20 bp, Artificial Sequence
  sgRNA
  Slc24a2_17
cgagaactttgtcttccagg

SEQ ID NO: 55019 - DNA, 20 bp, Artificial Sequence
  sgRNA
  Slc24a2_18
agtctaagagagttctttga

SEQ ID NO: 55020 - DNA, 20 bp, Artificial Sequence
  sgRNA
  Slc24a2_19
tgttcccatgagtcaccatt

SEQ ID NO: 55021 - DNA, 20 bp, Artificial Sequence
  sgRNA
  Slc24a2_20
tggagccgaagaatgtgata

SEQ ID NO: 55022 - DNA, 20 bp, Artificial Sequence
  sgRNA
  Slc24a3_1
aatcccaattaagcacacag

SEQ ID NO: 55023 - DNA, 20 bp, Artificial Sequence
  sgRNA
  Slc24a3_2
ggccccagagctgttcacgt

SEQ ID NO: 55024 - DNA, 20 bp, Artificial Sequence
  sgRNA
  Slc24a3_3
cagcaactgcgatgccactg

SEQ ID NO: 55025 - DNA, 20 bp, Artificial Sequence
  sgRNA
  Slc24a3_4
tccaatgaagaccgacgaca

SEQ ID NO: 55026 - DNA, 20 bp, Artificial Sequence
  sgRNA
  Slc24a3_5
gggtgtgaacggaacccgga

SEQ ID NO: 55027 - DNA, 20 bp, Artificial Sequence
  sgRNA
  Slc24a3_6
agagggctcatctactccgt

SEQ ID NO: 55028 - DNA, 20 bp, Artificial Sequence
  sgRNA
  Slc24a3_7
ggggtgtgaacggaacccgg

SEQ ID NO: 55029 - DNA, 20 bp, Artificial Sequence
  sgRNA
  Slc24a3_8
agccctgcatgaattcccca

SEQ ID NO: 55030 - DNA, 20 bp, Artificial Sequence
  sgRNA
  Slc24a3_9
gatgcacaggatgttgaaca

SEQ ID NO: 55031 - DNA, 20 bp, Artificial Sequence
  sgRNA
  Slc24a3_10
ggatccctgatgtcatcatg

SEQ ID NO: 55032 - DNA, 20 bp, Artificial Sequence
  sgRNA
  Slc24a3_11
gcatacaccagtgcttcgaa

SEQ ID NO: 55033 - DNA, 20 bp, Artificial Sequence
  sgRNA
  Slc24a3_12
ccgtcatgatggagaaacag

SEQ ID NO: 55034 - DNA, 20 bp, Artificial Sequence
  sgRNA
  Slc24a3_13
ggccacttcagattccccat

SEQ ID NO: 55035 - DNA, 20 bp, Artificial Sequence
  sgRNA
  Slc24a3_14
ccatcatcggctacacacta

SEQ ID NO: 55036 - DNA, 20 bp, Artificial Sequence
  sgRNA
  Slc24a3_15
gaccgacgtgaacagctctg

SEQ ID NO: 55037 - DNA, 20 bp, Artificial Sequence
  sgRNA
  Slc24a3_16
tggctgtgtccaattccatt

SEQ ID NO: 55038 - DNA, 20 bp, Artificial Sequence
  sgRNA
  Slc24a3_17
ccataaaccacttctcccag

SEQ ID NO: 55039 - DNA, 20 bp, Artificial Sequence
  sgRNA
  Slc24a3_18
ccagagcagcagcgccaccg

SEQ ID NO: 55040 - DNA, 20 bp, Artificial Sequence
  sgRNA
  Slc24a3_19
gattaacatgcgactggcca

SEQ ID NO: 55041 - DNA, 20 bp, Artificial Sequence
  sgRNA
  Slc24a3_20
ggcttgtgatcataattcga

SEQ ID NO: 55042 - DNA, 20 bp, Artificial Sequence
  sgRNA
  Slc24a4_1
tctcatccaccataaccacg

SEQ ID NO: 55043 - DNA, 20 bp, Artificial Sequence
  sgRNA
  Slc24a4_2
acccacggagatgtcggtgt

SEQ ID NO: 55044 - DNA, 20 bp, Artificial Sequence
  sgRNA
  Slc24a4_3
tctgtgcagttcttagccag

SEQ ID NO: 55045 - DNA, 20 bp, Artificial Sequence
  sgRNA
  Slc24a4_4
aaacgggagacatgagaaca

SEQ ID NO: 55046 - DNA, 20 bp, Artificial Sequence
  sgRNA
  Slc24a4_5
ggatccataattaataacca

SEQ ID NO: 55047 - DNA, 20 bp, Artificial Sequence
  sgRNA
  Slc24a4_6
gaacacttgtgcctgccgcc

SEQ ID NO: 55048 - DNA, 20 bp, Artificial Sequence
  sgRNA
  Slc24a4_7
catgggcatcaccttcctgg

SEQ ID NO: 55049 - DNA, 20 bp, Artificial Sequence
  sgRNA
  Slc24a4_8
gcgtgtagtacacagagtca

SEQ ID NO: 55050 - DNA, 20 bp, Artificial Sequence
  sgRNA
  Slc24a4_9
ggtggggcttggcatcccgt

SEQ ID NO: 55051 - DNA, 20 bp, Artificial Sequence
  sgRNA
  Slc24a4_10
gccccagcaatggcacagaa

SEQ ID NO: 55052 - DNA, 20 bp, Artificial Sequence
  sgRNA
  Slc24a4_11
atgaagaacttctcccagcg

SEQ ID NO: 55053 - DNA, 20 bp, Artificial Sequence
  sgRNA
  Slc24a4_12
ccggggtctggtctattccg

SEQ ID NO: 55054 - DNA, 20 bp, Artificial Sequence
  sgRNA
  Slc24a4_13
tgttggagaacaggtctgtg

SEQ ID NO: 55055 - DNA, 20 bp, Artificial Sequence
  sgRNA
  Slc24a4_14
cgtcatagctaccatcatag

SEQ ID NO: 55056 - DNA, 20 bp, Artificial Sequence
  sgRNA
  Slc24a4_15
ggtgatgcccatgatgacat

SEQ ID NO: 55057 - DNA, 20 bp, Artificial Sequence
  sgRNA
  Slc24a4_16
ttgggcccaggactcgacta

SEQ ID NO: 55058 - DNA, 20 bp, Artificial Sequence
  sgRNA
  Slc24a4_17
tcctacaccgacatctccgt

SEQ ID NO: 55059 - DNA, 20 bp, Artificial Sequence
  sgRNA
  Slc24a4_18
ctatcattatggagaagcac

SEQ ID NO: 55060 - DNA, 20 bp, Artificial Sequence
  sgRNA
  Slc24a4_19
ccacggaatagaccagaccc

SEQ ID NO: 55061 - DNA, 20 bp, Artificial Sequence
  sgRNA
  Slc24a4_20
gcacatgggcaagttgacga

SEQ ID NO: 55062 - DNA, 20 bp, Artificial Sequence
  sgRNA
  Slc24a5_1
cctttgtgataaatacacct

SEQ ID NO: 55063 - DNA, 20 bp, Artificial Sequence
  sgRNA
  Slc24a5_2
aagcaggagagcacggatgg

SEQ ID NO: 55064 - DNA, 20 bp, Artificial Sequence
  sgRNA
  Slc24a5_3
tctgcatacctgcctgtccg

SEQ ID NO: 55065 - DNA, 20 bp, Artificial Sequence
  sgRNA
  Slc24a5_4
acagtcactgatgatttcca

SEQ ID NO: 55066 - DNA, 20 bp, Artificial Sequence
  sgRNA
  Slc24a5_5
ccagcatcggagtttcccga

SEQ ID NO: 55067 - DNA, 20 bp, Artificial Sequence
  sgRNA
  Slc24a5_6
aacatcctgcgacagtccaa

SEQ ID NO: 55068 - DNA, 20 bp, Artificial Sequence
  sgRNA
  Slc24a5_7
ggcatgctgaaaacacttgg

SEQ ID NO: 55069 - DNA, 20 bp, Artificial Sequence
  sgRNA
  Slc24a5_8
gggatcccagacacagtgat

SEQ ID NO: 55070 - DNA, 20 bp, Artificial Sequence
  sgRNA
  Slc24a5_9
ttactgtgaccatccaaact

SEQ ID NO: 55071 - DNA, 20 bp, Artificial Sequence
  sgRNA
  Slc24a5_10
cagcatcggagtttcccgaa

SEQ ID NO: 55072 - DNA, 20 bp, Artificial Sequence
  sgRNA
  Slc24a5_11
gcagacactgttgggatggg

SEQ ID NO: 55073 - DNA, 20 bp, Artificial Sequence
  sgRNA
  Slc24a5_12
atgtgctgtctctccagcat

SEQ ID NO: 55074 - DNA, 20 bp, Artificial Sequence
  sgRNA
  Slc24a5_13
ctgcttggtgaagaaccctt

SEQ ID NO: 55075 - DNA, 20 bp, Artificial Sequence
  sgRNA
  Slc24a5_14
gcagggctgctactgatata

SEQ ID NO: 55076 - DNA, 20 bp, Artificial Sequence
  sgRNA
  Slc24a5_15
aatgcagtcttaataaacca

SEQ ID NO: 55077 - DNA, 20 bp, Artificial Sequence
  sgRNA
  Slc24a5_16
gcatagcatatcaaacacat

SEQ ID NO: 55078 - DNA, 20 bp, Artificial Sequence
  sgRNA
  Slc24a5_17
caagtcctaagtataacact

SEQ ID NO: 55079 - DNA, 20 bp, Artificial Sequence
  sgRNA
  Slc24a5_18
tctcctccatagctctggca

SEQ ID NO: 55080 - DNA, 20 bp, Artificial Sequence
  sgRNA
  Slc24a5_19
ggtgcaactttcatggcagc

SEQ ID NO: 55081 - DNA, 20 bp, Artificial Sequence
  sgRNA
  Slc24a5_20
agatggccatgcacatgtag

SEQ ID NO: 55082 - DNA, 20 bp, Artificial Sequence
  sgRNA
  Slc26a1_1
acaggccaacatatgtgatg

SEQ ID NO: 55083 - DNA, 20 bp, Artificial Sequence
  sgRNA
  Slc26a1_2
ccagccggaggatacccatg

SEQ ID NO: 55084 - DNA, 20 bp, Artificial Sequence
  sgRNA
  Slc26a1_3
taccagaccctaagataatg

SEQ ID NO: 55085 - DNA, 20 bp, Artificial Sequence
  sgRNA
  Slc26a1_4
gcccacattaacatggcggg

SEQ ID NO: 55086 - DNA, 20 bp, Artificial Sequence
  sgRNA
  Slc26a1_5
tctcaacgtgtctctcaccg

SEQ ID NO: 55087 - DNA, 20 bp, Artificial Sequence
  sgRNA
  Slc26a1_6
ctcggtgctgactagcacac

SEQ ID NO: 55088 - DNA, 20 bp, Artificial Sequence
  sgRNA
  Slc26a1_7
ctgtgtgctagtcagcaccg

SEQ ID NO: 55089 - DNA, 20 bp, Artificial Sequence
  sgRNA
  Slc26a1_8
gtgcagatccctcggcacca

SEQ ID NO: 55090 - DNA, 20 bp, Artificial Sequence
  sgRNA
  Slc26a1_9
cccagaccagtgcatcggca

SEQ ID NO: 55091 - DNA, 20 bp, Artificial Sequence
  sgRNA
  Slc26a1_10
atagcaaagccatcgagcag

SEQ ID NO: 55092 - DNA, 20 bp, Artificial Sequence
  sgRNA
  Slc26a1_11
gcagcaagctcaaccatgtg

SEQ ID NO: 55093 - DNA, 20 bp, Artificial Sequence
  sgRNA
  Slc26a1_12
tctcctgagccccaacagaa

SEQ ID NO: 55094 - DNA, 20 bp, Artificial Sequence
  sgRNA
  Slc26a1_13
tctggcttgctgcagtccct

SEQ ID NO: 55095 - DNA, 20 bp, Artificial Sequence
  sgRNA
  Slc26a1_14
tgggtattggcaccttcaga

SEQ ID NO: 55096 - DNA, 20 bp, Artificial Sequence
  sgRNA
  Slc26a1_15
ggtggacagagaactccagt

SEQ ID NO: 55097 - DNA, 20 bp, Artificial Sequence
  sgRNA
  Slc26a1_16
tctcaggcaaaacacatgct

SEQ ID NO: 55098 - DNA, 20 bp, Artificial Sequence
  sgRNA
  Slc26a1_17
cattgttgtcagcctgcggg

SEQ ID NO: 55099 - DNA, 20 bp, Artificial Sequence
  sgRNA
  Slc26a1_18
tggagactccaccttctatg

SEQ ID NO: 55100 - DNA, 20 bp, Artificial Sequence
  sgRNA
  Slc26a1_19
tagacacgaagcccagccgg

SEQ ID NO: 55101 - DNA, 20 bp, Artificial Sequence
  sgRNA
  Slc26a1_20
ccacacgccacattatctta

SEQ ID NO: 55102 - DNA, 20 bp, Artificial Sequence
  sgRNA
  Slc26a2_1
gagccgacaccatgactccg

SEQ ID NO: 55103 - DNA, 20 bp, Artificial Sequence
  sgRNA
  Slc26a2_2
atggccggagagctttccgt

SEQ ID NO: 55104 - DNA, 20 bp, Artificial Sequence
  sgRNA
  Slc26a2_3
actgtgccttatgattggtg

SEQ ID NO: 55105 - DNA, 20 bp, Artificial Sequence
  sgRNA
  Slc26a2_4
tccaaaatgagaagccaatg

SEQ ID NO: 55106 - DNA, 20 bp, Artificial Sequence
  sgRNA
  Slc26a2_5
tctttggcttctgagtacgg

SEQ ID NO: 55107 - DNA, 20 bp, Artificial Sequence
  sgRNA
  Slc26a2_6
agaaatggtgacctttcgtg

SEQ ID NO: 55108 - DNA, 20 bp, Artificial Sequence
  sgRNA
  Slc26a2_7
gcaatgggcttctttcaagt

SEQ ID NO: 55109 - DNA, 20 bp, Artificial Sequence
  sgRNA
  Slc26a2_8
acgatagtgtgcacctccaa

SEQ ID NO: 55110 - DNA, 20 bp, Artificial Sequence
  sgRNA
  Slc26a2_9
gcaatattctcctctggcca

SEQ ID NO: 55111 - DNA, 20 bp, Artificial Sequence
  sgRNA
  Slc26a2_10
ttaccagaaggaccaacaaa

SEQ ID NO: 55112 - DNA, 20 bp, Artificial Sequence
  sgRNA
  Slc26a2_11
ggaatactgtgccttatgat

SEQ ID NO: 55113 - DNA, 20 bp, Artificial Sequence
  sgRNA
  Slc26a2_12
ttcagtgcttaacagagcgg

SEQ ID NO: 55114 - DNA, 20 bp, Artificial Sequence
  sgRNA
  Slc26a2_13
ttagcctccacatctttggc

SEQ ID NO: 55115 - DNA, 20 bp, Artificial Sequence
  sgRNA
  Slc26a2_14
gcagcatgacctctcaccga

SEQ ID NO: 55116 - DNA, 20 bp, Artificial Sequence
  sgRNA
  Slc26a2_15
ttgggtggcataaacccagt

SEQ ID NO: 55117 - DNA, 20 bp, Artificial Sequence
  sgRNA
  Slc26a2_16
atcactattgtaaatctccg

SEQ ID NO: 55118 - DNA, 20 bp, Artificial Sequence
  sgRNA
  Slc26a2_17
cagtaaaacctggatcccaa

SEQ ID NO: 55119 - DNA, 20 bp, Artificial Sequence
  sgRNA
  Slc26a2_18
gccgggattatgaagccgtt

SEQ ID NO: 55120 - DNA, 20 bp, Artificial Sequence
  sgRNA
  Slc26a2_19
ggatcctacggaaagctctc

SEQ ID NO: 55121 - DNA, 20 bp, Artificial Sequence
  sgRNA
  Slc26a2_20
accttctttgagtctccagg

SEQ ID NO: 55122 - DNA, 20 bp, Artificial Sequence
  sgRNA
  Slc26a3_1
ctatccgagtccctaatcag

SEQ ID NO: 55123 - DNA, 20 bp, Artificial Sequence
  sgRNA
  Slc26a3_2
tccacgctgggtgtaatagg

SEQ ID NO: 55124 - DNA, 20 bp, Artificial Sequence
  sgRNA
  Slc26a3_3
ctggcaaccaagatgctatg

SEQ ID NO: 55125 - DNA, 20 bp, Artificial Sequence
  sgRNA
  Slc26a3_4
taatccgagtccaaggacaa

SEQ ID NO: 55126 - DNA, 20 bp, Artificial Sequence
  sgRNA
  Slc26a3_5
gtatttgagggagtacacgc

SEQ ID NO: 55127 - DNA, 20 bp, Artificial Sequence
  sgRNA
  Slc26a3_6
ccgttccagtctatgtcaaa

SEQ ID NO: 55128 - DNA, 20 bp, Artificial Sequence
  sgRNA
  Slc26a3_7
cctaatcagtggcttcacca

SEQ ID NO: 55129 - DNA, 20 bp, Artificial Sequence
  sgRNA
  Slc26a3_8
gagcattcaaaggatttgca

SEQ ID NO: 55130 - DNA, 20 bp, Artificial Sequence
  sgRNA
  Slc26a3_9
tgatcgtcatagttgccatt

SEQ ID NO: 55131 - DNA, 20 bp, Artificial Sequence
  sgRNA
  Slc26a3_10
gttgttgtccaattcttcgt

SEQ ID NO: 55132 - DNA, 20 bp, Artificial Sequence
  sgRNA
  Slc26a3_11
ctttgacatagactggaacg

SEQ ID NO: 55133 - DNA, 20 bp, Artificial Sequence
  sgRNA
  Slc26a3_12
ttagcccacttcgaattcta

SEQ ID NO: 55134 - DNA, 20 bp, Artificial Sequence
  sgRNA
  Slc26a3_13
gggtttatatgcacctctga

SEQ ID NO: 55135 - DNA, 20 bp, Artificial Sequence
  sgRNA
  Slc26a3_14
cactgattagggactcggat

SEQ ID NO: 55136 - DNA, 20 bp, Artificial Sequence
  sgRNA
  Slc26a3_15
aatcggataatcgtatttga

SEQ ID NO: 55137 - DNA, 20 bp, Artificial Sequence
  sgRNA
  Slc26a3_16
ctttgaagacaggtttggcg

SEQ ID NO: 55138 - DNA, 20 bp, Artificial Sequence
  sgRNA
  Slc26a3_17
agacaggtttggcgtggccg

SEQ ID NO: 55139 - DNA, 20 bp, Artificial Sequence
  sgRNA
  Slc26a3_18
gaaatgctacacttgccgcc

SEQ ID NO: 55140 - DNA, 20 bp, Artificial Sequence
  sgRNA
  Slc26a3_19
ggagtctttgaaaccgtcag

SEQ ID NO: 55141 - DNA, 20 bp, Artificial Sequence
  sgRNA
  Slc26a3_20
ctagcactcggaaacttaaa

SEQ ID NO: 55142 - DNA, 20 bp, Artificial Sequence
  sgRNA
  Slc26a4_1
ttgtgaatccgccaaccaag

SEQ ID NO: 55143 - DNA, 20 bp, Artificial Sequence
  sgRNA
  Slc26a4_2
gctcccaaaataccgagtca

SEQ ID NO: 55144 - DNA, 20 bp, Artificial Sequence
  sgRNA
  Slc26a4_3
tctggttccagtgtctaacg

SEQ ID NO: 55145 - DNA, 20 bp, Artificial Sequence
  sgRNA
  Slc26a4_4
gaagacgttgcttatcccaa

SEQ ID NO: 55146 - DNA, 20 bp, Artificial Sequence
  sgRNA
  Slc26a4_5
atattgccgatttcatcgct

SEQ ID NO: 55147 - DNA, 20 bp, Artificial Sequence
  sgRNA
  Slc26a4_6
tcatctccggagttagcact

SEQ ID NO: 55148 - DNA, 20 bp, Artificial Sequence
  sgRNA
  Slc26a4_7
aatgcacttccgttaccgct

SEQ ID NO: 55149 - DNA, 20 bp, Artificial Sequence
  sgRNA
  Slc26a4_8
gtttcaaccaaaaactacaa

SEQ ID NO: 55150 - DNA, 20 bp, Artificial Sequence
  sgRNA
  Slc26a4_9
aaggcgagctcgctgtacac

SEQ ID NO: 55151 - DNA, 20 bp, Artificial Sequence
  sgRNA
  Slc26a4_10
ttagctgtgagaccagtact

SEQ ID NO: 55152 - DNA, 20 bp, Artificial Sequence
  sgRNA
  Slc26a4_11
tcgacattgccgtaaaaaat

SEQ ID NO: 55153 - DNA, 20 bp, Artificial Sequence
  sgRNA
  Slc26a4_12
agaccctcttgatctgatgg

SEQ ID NO: 55154 - DNA, 20 bp, Artificial Sequence
  sgRNA
  Slc26a4_13
ttattctgcttccacagacg

SEQ ID NO: 55155 - DNA, 20 bp, Artificial Sequence
  sgRNA
  Slc26a4_14
taaaaaatgtatcaattcaa

SEQ ID NO: 55156 - DNA, 20 bp, Artificial Sequence
  sgRNA
  Slc26a4_15
ctgcctccatcagatcaaga

SEQ ID NO: 55157 - DNA, 20 bp, Artificial Sequence
  sgRNA
  Slc26a4_16
gctgaccatcatcgtctgta

SEQ ID NO: 55158 - DNA, 20 bp, Artificial Sequence
  sgRNA
  Slc26a4_17
agccgttcgagacagagcag

SEQ ID NO: 55159 - DNA, 20 bp, Artificial Sequence
  sgRNA
  Slc26a4_18
agcatgactatgtcatcgat

SEQ ID NO: 55160 - DNA, 20 bp, Artificial Sequence
  sgRNA
  Slc26a4_19
aactcgaccacgttagacac

SEQ ID NO: 55161 - DNA, 20 bp, Artificial Sequence
  sgRNA
  Slc26a4_20
gctgcagttacacggtgtcg

SEQ ID NO: 55162 - DNA, 20 bp, Artificial Sequence
  sgRNA
  Slc26a5_1
ggtgcgaggctttaccactg

SEQ ID NO: 55163 - DNA, 20 bp, Artificial Sequence
  sgRNA
  Slc26a5_2
cctacatgagtcctacagtg

SEQ ID NO: 55164 - DNA, 20 bp, Artificial Sequence
  sgRNA
  Slc26a5_3
gatgagtacaggccaaacac

SEQ ID NO: 55165 - DNA, 20 bp, Artificial Sequence
  sgRNA
  Slc26a5_4
tgacgatcacaatggcggaa

SEQ ID NO: 55166 - DNA, 20 bp, Artificial Sequence
  sgRNA
  Slc26a5_5
agagacccagaggtactacg

SEQ ID NO: 55167 - DNA, 20 bp, Artificial Sequence
  sgRNA
  Slc26a5_6
cgactcaaagaggaatccgg

SEQ ID NO: 55168 - DNA, 20 bp, Artificial Sequence
  sgRNA
  Slc26a5_7
gctggcagccacttagtgat

SEQ ID NO: 55169 - DNA, 20 bp, Artificial Sequence
  sgRNA
  Slc26a5_8
tgttcctgcctatcactaag

SEQ ID NO: 55170 - DNA, 20 bp, Artificial Sequence
  sgRNA
  Slc26a5_9
aggacaggatgactgaagat

SEQ ID NO: 55171 - DNA, 20 bp, Artificial Sequence
  sgRNA
  Slc26a5_10
atcatctggtactaaccgga

SEQ ID NO: 55172 - DNA, 20 bp, Artificial Sequence
  sgRNA
  Slc26a5_11
gaccaacagaatcatcaacg

SEQ ID NO: 55173 - DNA, 20 bp, Artificial Sequence
  sgRNA
  Slc26a5_12
tttgtgtcctccctgttcct

SEQ ID NO: 55174 - DNA, 20 bp, Artificial Sequence
  sgRNA
  Slc26a5_13
ctcgcaccaatggctccgtg

SEQ ID NO: 55175 - DNA, 20 bp, Artificial Sequence
  sgRNA
  Slc26a5_14
cctctttgagtcgttacccc

SEQ ID NO: 55176 - DNA, 20 bp, Artificial Sequence
  sgRNA
  Slc26a5_15
aacgtgtgttccctaggcgt

SEQ ID NO: 55177 - DNA, 20 bp, Artificial Sequence
  sgRNA
  Slc26a5_16
aatggagttgcatatcccca

SEQ ID NO: 55178 - DNA, 20 bp, Artificial Sequence
  sgRNA
  Slc26a5_17
tgtcattctagactttacgc

SEQ ID NO: 55179 - DNA, 20 bp, Artificial Sequence
  sgRNA
  Slc26a5_18
atttgtggccatatacctca

SEQ ID NO: 55180 - DNA, 20 bp, Artificial Sequence
  sgRNA
  Slc26a5_19
gagcagagcaatgatcacgg

SEQ ID NO: 55181 - DNA, 20 bp, Artificial Sequence
  sgRNA
  Slc26a5_20
ccacactgtaggactcatgt

SEQ ID NO: 55182 - DNA, 20 bp, Artificial Sequence
  sgRNA
  Slc26a6_1
ggccagataacagatcaccc

SEQ ID NO: 55183 - DNA, 20 bp, Artificial Sequence
  sgRNA
  Slc26a6_2
tcgccattgccatctcactg

SEQ ID NO: 55184 - DNA, 20 bp, Artificial Sequence
  sgRNA
  Slc26a6_3
agcattggcgaagtacagcg

SEQ ID NO: 55185 - DNA, 20 bp, Artificial Sequence
  sgRNA
  Slc26a6_4
tggtgggcaacatcaccaca

SEQ ID NO: 55186 - DNA, 20 bp, Artificial Sequence
  sgRNA
  Slc26a6_5
atgcagccgtggtatagctg

SEQ ID NO: 55187 - DNA, 20 bp, Artificial Sequence
  sgRNA
  Slc26a6_6
tgagactgtgcccggcaccg

SEQ ID NO: 55188 - DNA, 20 bp, Artificial Sequence
  sgRNA
  Slc26a6_7
cctgggccaaagcttaataa

SEQ ID NO: 55189 - DNA, 20 bp, Artificial Sequence
  sgRNA
  Slc26a6_8
gccatcatgcagcttcctca

SEQ ID NO: 55190 - DNA, 20 bp, Artificial Sequence
  sgRNA
  Slc26a6_9
actggaagaagcctccaatg

SEQ ID NO: 55191 - DNA, 20 bp, Artificial Sequence
  sgRNA
  Slc26a6_10
gaaccaagttcgccactggt

SEQ ID NO: 55192 - DNA, 20 bp, Artificial Sequence
  sgRNA
  Slc26a6_11
tgatgacatgcagtaccacc

SEQ ID NO: 55193 - DNA, 20 bp, Artificial Sequence
  sgRNA
  Slc26a6_12
ctaccgtgtggacagtaacc

SEQ ID NO: 55194 - DNA, 20 bp, Artificial Sequence
  sgRNA
  Slc26a6_13
catgtctcggagcttggtac

SEQ ID NO: 55195 - DNA, 20 bp, Artificial Sequence
  sgRNA
  Slc26a6_14
agtacagcgtggctgaggaa

SEQ ID NO: 55196 - DNA, 20 bp, Artificial Sequence
  sgRNA
  Slc26a6_15
gcttcaagctgggcgaccac

SEQ ID NO: 55197 - DNA, 20 bp, Artificial Sequence
  sgRNA
  Slc26a6_16
tctggtccgcagctatacca

SEQ ID NO: 55198 - DNA, 20 bp, Artificial Sequence
  sgRNA
  Slc26a6_17
gctgtaatgtctgtgatggt

SEQ ID NO: 55199 - DNA, 20 bp, Artificial Sequence
  sgRNA
  Slc26a6_18
cctgaggcatggctaccgtg

SEQ ID NO: 55200 - DNA, 20 bp, Artificial Sequence
  sgRNA
  Slc26a6_19
tgacctttgccctcagccac

SEQ ID NO: 55201 - DNA, 20 bp, Artificial Sequence
  sgRNA
  Slc26a6_20
cacaccataggaaataccag

SEQ ID NO: 55202 - DNA, 20 bp, Artificial Sequence
  sgRNA
  Slc26a8_1
tgggatcatcttaagcaatg

SEQ ID NO: 55203 - DNA, 20 bp, Artificial Sequence
  sgRNA
  Slc26a8_2
aaatgttaatgactaccggg

SEQ ID NO: 55204 - DNA, 20 bp, Artificial Sequence
  sgRNA
  Slc26a8_3
gcgtaagtgacgttgagggg

SEQ ID NO: 55205 - DNA, 20 bp, Artificial Sequence
  sgRNA
  Slc26a8_4
acttacaagcaagataacca

SEQ ID NO: 55206 - DNA, 20 bp, Artificial Sequence
  sgRNA
  Slc26a8_5
taagcggagcgtgtacaacg

SEQ ID NO: 55207 - DNA, 20 bp, Artificial Sequence
  sgRNA
  Slc26a8_6
ctttgatgaaggcatcacga

SEQ ID NO: 55208 - DNA, 20 bp, Artificial Sequence
  sgRNA
  Slc26a8_7
atcgatgtccacgttcccag

SEQ ID NO: 55209 - DNA, 20 bp, Artificial Sequence
  sgRNA
  Slc26a8_8
agtcgtcctggacaaactac

SEQ ID NO: 55210 - DNA, 20 bp, Artificial Sequence
  sgRNA
  Slc26a8_9
gcaacctaagactcaaaacg

SEQ ID NO: 55211 - DNA, 20 bp, Artificial Sequence
  sgRNA
  Slc26a8_10
ctcaaacgacttgaccacag

SEQ ID NO: 55212 - DNA, 20 bp, Artificial Sequence
  sgRNA
  Slc26a8_11
gcagtgaagtagttccgcca

SEQ ID NO: 55213 - DNA, 20 bp, Artificial Sequence
  sgRNA
  Slc26a8_12
gcatctcaggaacttgtgcc

SEQ ID NO: 55214 - DNA, 20 bp, Artificial Sequence
  sgRNA
  Slc26a8_13
actatccaggacaaatctgg

SEQ ID NO: 55215 - DNA, 20 bp, Artificial Sequence
  sgRNA
  Slc26a8_14
catggccacatatcttccag

SEQ ID NO: 55216 - DNA, 20 bp, Artificial Sequence
  sgRNA
  Slc26a8_15
gctccatggggaactcgata

SEQ ID NO: 55217 - DNA, 20 bp, Artificial Sequence
  sgRNA
  Slc26a8_16
tttgcctctctggtaggcgc

SEQ ID NO: 55218 - DNA, 20 bp, Artificial Sequence
  sgRNA
  Slc26a8_17
tcatgtcatcaaatgtccat

SEQ ID NO: 55219 - DNA, 20 bp, Artificial Sequence
  sgRNA
  Slc26a8_18
gagcaacctaagactcaaaa

SEQ ID NO: 55220 - DNA, 20 bp, Artificial Sequence
  sgRNA
  Slc26a8_19
atcaggtgaccattgttgaa

SEQ ID NO: 55221 - DNA, 20 bp, Artificial Sequence
  sgRNA
  Slc26a8_20
acaacttacccagtttgtgg

SEQ ID NO: 55222 - DNA, 20 bp, Artificial Sequence
  sgRNA
  Slc26a9_1
ttgtgggggagatccgacaa

SEQ ID NO: 55223 - DNA, 20 bp, Artificial Sequence
  sgRNA
  Slc26a9_2
gggtctggaagatcacaacc

SEQ ID NO: 55224 - DNA, 20 bp, Artificial Sequence
  sgRNA
  Slc26a9_3
agagagcgcagcaaatgacg

SEQ ID NO: 55225 - DNA, 20 bp, Artificial Sequence
  sgRNA
  Slc26a9_4
ttctagactcacaaagacga

SEQ ID NO: 55226 - DNA, 20 bp, Artificial Sequence
  sgRNA
  Slc26a9_5
acacccactgcgacaccgta

SEQ ID NO: 55227 - DNA, 20 bp, Artificial Sequence
  sgRNA
  Slc26a9_6
gaaccccaagacctacaaca

SEQ ID NO: 55228 - DNA, 20 bp, Artificial Sequence
  sgRNA
  Slc26a9_7
tggcgagtaatactttctgg

SEQ ID NO: 55229 - DNA, 20 bp, Artificial Sequence
  sgRNA
  Slc26a9_8
tggcaccgatggtttcgcag

SEQ ID NO: 55230 - DNA, 20 bp, Artificial Sequence
  sgRNA
  Slc26a9_9
ctatctgtaccctctcccca

SEQ ID NO: 55231 - DNA, 20 bp, Artificial Sequence
  sgRNA
  Slc26a9_10
tgtcaccaatgagacctacg

SEQ ID NO: 55232 - DNA, 20 bp, Artificial Sequence
  sgRNA
  Slc26a9_11
gggcaaagaggactgcatcg

SEQ ID NO: 55233 - DNA, 20 bp, Artificial Sequence
  sgRNA
  Slc26a9_12
cttgcagctcccagagatag

SEQ ID NO: 55234 - DNA, 20 bp, Artificial Sequence
  sgRNA
  Slc26a9_13
gtgtataatgacatcagcca

SEQ ID NO: 55235 - DNA, 20 bp, Artificial Sequence
  sgRNA
  Slc26a9_14
gcagacagatgttacccacc

SEQ ID NO: 55236 - DNA, 20 bp, Artificial Sequence
  sgRNA
  Slc26a9_15
tccttccactgcgaaaccat

SEQ ID NO: 55237 - DNA, 20 bp, Artificial Sequence
  sgRNA
  Slc26a9_16
gagtgtcactagcctcctgg

SEQ ID NO: 55238 - DNA, 20 bp, Artificial Sequence
  sgRNA
  Slc26a9_17
cccagaccgcaacttccatg

SEQ ID NO: 55239 - DNA, 20 bp, Artificial Sequence
  sgRNA
  Slc26a9_18
gctctgtctaccacgtagcg

SEQ ID NO: 55240 - DNA, 20 bp, Artificial Sequence
  sgRNA
  Slc26a9_19
gaaggaccgtgcctacccgg

SEQ ID NO: 55241 - DNA, 20 bp, Artificial Sequence
  sgRNA
  Slc26a9_20
tctctcccaccgggtaggca

SEQ ID NO: 55242 - DNA, 20 bp, Artificial Sequence
  sgRNA
  Slc28a1_1
ggtcttcctgagttacaccg

SEQ ID NO: 55243 - DNA, 20 bp, Artificial Sequence
  sgRNA
  Slc28a1_2
aaaagttctacctaccccaa

SEQ ID NO: 55244 - DNA, 20 bp, Artificial Sequence
  sgRNA
  Slc28a1_3
aaggcgtgaagctgacgtat

SEQ ID NO: 55245 - DNA, 20 bp, Artificial Sequence
  sgRNA
  Slc28a1_4
agccactgaaaccctaagtg

SEQ ID NO: 55246 - DNA, 20 bp, Artificial Sequence
  sgRNA
  Slc28a1_5
gatcctctatgtgccccggg

SEQ ID NO: 55247 - DNA, 20 bp, Artificial Sequence
  sgRNA
  Slc28a1_6
gcgccctcgggaagtccagg

SEQ ID NO: 55248 - DNA, 20 bp, Artificial Sequence
  sgRNA
  Slc28a1_7
gctacgggcactgatcacag

SEQ ID NO: 55249 - DNA, 20 bp, Artificial Sequence
  sgRNA
  Slc28a1_8
gtactgggaaagctcttgat

SEQ ID NO: 55250 - DNA, 20 bp, Artificial Sequence
  sgRNA
  Slc28a1_9
cctgcctcctggacttcccg

SEQ ID NO: 55251 - DNA, 20 bp, Artificial Sequence
  sgRNA
  Slc28a1_10
aggcactcaagcctgccaga

SEQ ID NO: 55252 - DNA, 20 bp, Artificial Sequence
  sgRNA
  Slc28a1_11
gaagttggcgaatccacaga

SEQ ID NO: 55253 - DNA, 20 bp, Artificial Sequence
  sgRNA
  Slc28a1_12
ctgcctcctggacttcccga

SEQ ID NO: 55254 - DNA, 20 bp, Artificial Sequence
  sgRNA
  Slc28a1_13
ggcttggtgacaagaaacag

SEQ ID NO: 55255 - DNA, 20 bp, Artificial Sequence
  sgRNA
  Slc28a1_14
tgccacacaggcgtttacca

SEQ ID NO: 55256 - DNA, 20 bp, Artificial Sequence
  sgRNA
  Slc28a1_15
aattgctgcctcagtcatgg

SEQ ID NO: 55257 - DNA, 20 bp, Artificial Sequence
  sgRNA
  Slc28a1_16
aggagatgtaggcgcccagg

SEQ ID NO: 55258 - DNA, 20 bp, Artificial Sequence
  sgRNA
  Slc28a1_17
gatgtttcctgccacactta

SEQ ID NO: 55259 - DNA, 20 bp, Artificial Sequence
  sgRNA
  Slc28a1_18
tggttgatgcaggtcaccat

SEQ ID NO: 55260 - DNA, 20 bp, Artificial Sequence
  sgRNA
  Slc28a1_19
gctccattggcatcatgctg

SEQ ID NO: 55261 - DNA, 20 bp, Artificial Sequence
  sgRNA
  Slc28a1_20
gcaagcgagaagcctctgca

SEQ ID NO: 55262 - DNA, 20 bp, Artificial Sequence
  sgRNA
  Slc28a2_1
tcttgagcaaagatacacac

SEQ ID NO: 55263 - DNA, 20 bp, Artificial Sequence
  sgRNA
  Slc28a2_2
tggacaaggcaagtgcacaa

SEQ ID NO: 55264 - DNA, 20 bp, Artificial Sequence
  sgRNA
  Slc28a2_3
agagagtcctacgaacaccc

SEQ ID NO: 55265 - DNA, 20 bp, Artificial Sequence
  sgRNA
  Slc28a2_4
tggttcctgcaaattaccat

SEQ ID NO: 55266 - DNA, 20 bp, Artificial Sequence
  sgRNA
  Slc28a2_5
ctttgcccaaagattcaggt

SEQ ID NO: 55267 - DNA, 20 bp, Artificial Sequence
  sgRNA
  Slc28a2_6
tgagcaaagatacacacagg

SEQ ID NO: 55268 - DNA, 20 bp, Artificial Sequence
  sgRNA
  Slc28a2_7
ccactatctcagccaccagt

SEQ ID NO: 55269 - DNA, 20 bp, Artificial Sequence
  sgRNA
  Slc28a2_8
acacaggaggaagtgacaca

SEQ ID NO: 55270 - DNA, 20 bp, Artificial Sequence
  sgRNA
  Slc28a2_9
acacccatcatgaaaaccat

SEQ ID NO: 55271 - DNA, 20 bp, Artificial Sequence
  sgRNA
  Slc28a2_10
tcttgtactgagacagttgc

SEQ ID NO: 55272 - DNA, 20 bp, Artificial Sequence
  sgRNA
  Slc28a2_11
catttcccccagccaagaga

SEQ ID NO: 55273 - DNA, 20 bp, Artificial Sequence
  sgRNA
  Slc28a2_12
ctgtgtcgagagccagccag

SEQ ID NO: 55274 - DNA, 20 bp, Artificial Sequence
  sgRNA
  Slc28a2_13
gtactgagacagttgctggt

SEQ ID NO: 55275 - DNA, 20 bp, Artificial Sequence
  sgRNA
  Slc28a2_14
gatgtttcctgccacggcca

SEQ ID NO: 55276 - DNA, 20 bp, Artificial Sequence
  sgRNA
  Slc28a2_15
ggggaaatggtggatatcca

SEQ ID NO: 55277 - DNA, 20 bp, Artificial Sequence
  sgRNA
  Slc28a2_16
aatgccccaagccatcctcc

SEQ ID NO: 55278 - DNA, 20 bp, Artificial Sequence
  sgRNA
  Slc28a2_17
acctgaatctttgggcaaag

SEQ ID NO: 55279 - DNA, 20 bp, Artificial Sequence
  sgRNA
  Slc28a2_18
gcaattctccactgtggcct

SEQ ID NO: 55280 - DNA, 20 bp, Artificial Sequence
  sgRNA
  Slc28a2_19
gacacagggacacagcctgg

SEQ ID NO: 55281 - DNA, 20 bp, Artificial Sequence
  sgRNA
  Slc28a2_20
gagaattgcatggagaaccc

SEQ ID NO: 55282 - DNA, 20 bp, Artificial Sequence
  sgRNA
  Slc28a3_1
agttccgacttggtgacgtg

SEQ ID NO: 55283 - DNA, 20 bp, Artificial Sequence
  sgRNA
  Slc28a3_2
tgcaggtgcggacatgaccg

SEQ ID NO: 55284 - DNA, 20 bp, Artificial Sequence
  sgRNA
  Slc28a3_3
aaggacacgccaaacaggta

SEQ ID NO: 55285 - DNA, 20 bp, Artificial Sequence
  sgRNA
  Slc28a3_4
tctgtggaagtttatcgcac

SEQ ID NO: 55286 - DNA, 20 bp, Artificial Sequence
  sgRNA
  Slc28a3_5
acagccagagaataatcgcc

SEQ ID NO: 55287 - DNA, 20 bp, Artificial Sequence
  sgRNA
  Slc28a3_6
ggttccctaggaatcgtgat

SEQ ID NO: 55288 - DNA, 20 bp, Artificial Sequence
  sgRNA
  Slc28a3_7
gcagcaactacagactcaat

SEQ ID NO: 55289 - DNA, 20 bp, Artificial Sequence
  sgRNA
  Slc28a3_8
tgattcaaggaatctcctgg

SEQ ID NO: 55290 - DNA, 20 bp, Artificial Sequence
  sgRNA
  Slc28a3_9
cgcacaggctgcaatcacca

SEQ ID NO: 55291 - DNA, 20 bp, Artificial Sequence
  sgRNA
  Slc28a3_10
accaataactgtgcaccggt

SEQ ID NO: 55292 - DNA, 20 bp, Artificial Sequence
  sgRNA
  Slc28a3_11
gtacatgatgagtccgccaa

SEQ ID NO: 55293 - DNA, 20 bp, Artificial Sequence
  sgRNA
  Slc28a3_12
cgaggcagttagcaaatgcg

SEQ ID NO: 55294 - DNA, 20 bp, Artificial Sequence
  sgRNA
  Slc28a3_13
gatgcagtggatcatcagaa

SEQ ID NO: 55295 - DNA, 20 bp, Artificial Sequence
  sgRNA
  Slc28a3_14
gcgaagatgagcatcagaaa

SEQ ID NO: 55296 - DNA, 20 bp, Artificial Sequence
  sgRNA
  Slc28a3_15
catcctctctgataccccgg

SEQ ID NO: 55297 - DNA, 20 bp, Artificial Sequence
  sgRNA
  Slc28a3_16
tatccaccggggtatcagag

SEQ ID NO: 55298 - DNA, 20 bp, Artificial Sequence
  sgRNA
  Slc28a3_17
ggtgctgaagaaaaccacga

SEQ ID NO: 55299 - DNA, 20 bp, Artificial Sequence
  sgRNA
  Slc28a3_18
atggcagttgatatccaccg

SEQ ID NO: 55300 - DNA, 20 bp, Artificial Sequence
  sgRNA
  Slc28a3_19
gggtcttctttgtttcctag

SEQ ID NO: 55301 - DNA, 20 bp, Artificial Sequence
  sgRNA
  Slc28a3_20
gtgctgaagaaaaccacgat

SEQ ID NO: 55302 - DNA, 20 bp, Artificial Sequence
  sgRNA
  Slc29a1_1
gctgatgcagaaacgagttg

SEQ ID NO: 55303 - DNA, 20 bp, Artificial Sequence
  sgRNA
  Slc29a1_2
gcatgattgatcagtgtccg

SEQ ID NO: 55304 - DNA, 20 bp, Artificial Sequence
  sgRNA
  Slc29a1_3
tacacagcccccatcatgag

SEQ ID NO: 55305 - DNA, 20 bp, Artificial Sequence
  sgRNA
  Slc29a1_4
ggccaaaatgacaactgcac

SEQ ID NO: 55306 - DNA, 20 bp, Artificial Sequence
  sgRNA
  Slc29a1_5
tcgtctttaagcatgacgcc

SEQ ID NO: 55307 - DNA, 20 bp, Artificial Sequence
  sgRNA
  Slc29a1_6
cattctgggacacgtccagg

SEQ ID NO: 55308 - DNA, 20 bp, Artificial Sequence
  sgRNA
  Slc29a1_7
acctgcagctcaaccttgcg

SEQ ID NO: 55309 - DNA, 20 bp, Artificial Sequence
  sgRNA
  Slc29a1_8
ggacacctgccagaccaaaa

SEQ ID NO: 55310 - DNA, 20 bp, Artificial Sequence
  sgRNA
  Slc29a1_9
gctgatgctctgcaacgtga

SEQ ID NO: 55311 - DNA, 20 bp, Artificial Sequence
  sgRNA
  Slc29a1_10
cacgttgcagagcatcagca

SEQ ID NO: 55312 - DNA, 20 bp, Artificial Sequence
  sgRNA
  Slc29a1_11
cgaccaaaaccggcagccag

SEQ ID NO: 55313 - DNA, 20 bp, Artificial Sequence
  sgRNA
  Slc29a1_12
acgttgcagagcatcagcag

SEQ ID NO: 55314 - DNA, 20 bp, Artificial Sequence
  sgRNA
  Slc29a1_13
tcatcttcacggttaccatt

SEQ ID NO: 55315 - DNA, 20 bp, Artificial Sequence
  sgRNA
  Slc29a1_14
ctacctggctctgcctcgga

SEQ ID NO: 55316 - DNA, 20 bp, Artificial Sequence
  sgRNA
  Slc29a1_15
cagtgacaaggaataccagc

SEQ ID NO: 55317 - DNA, 20 bp, Artificial Sequence
  sgRNA
  Slc29a1_16
agatggcactgagagaactc

SEQ ID NO: 55318 - DNA, 20 bp, Artificial Sequence
  sgRNA
  Slc29a1_17
ataccagcaggattgccagc

SEQ ID NO: 55319 - DNA, 20 bp, Artificial Sequence
  sgRNA
  Slc29a1_18
ggctgtgatgaagtagccaa

SEQ ID NO: 55320 - DNA, 20 bp, Artificial Sequence
  sgRNA
  Slc29a1_19
gcggtcataaaaaaattcca

SEQ ID NO: 55321 - DNA, 20 bp, Artificial Sequence
  sgRNA
  Slc29a1_20
gaggctggcgaggtagccat

SEQ ID NO: 55322 - DNA, 20 bp, Artificial Sequence
  sgRNA
  Slc29a2_1
caggctgaggtaacatacga

SEQ ID NO: 55323 - DNA, 20 bp, Artificial Sequence
  sgRNA
  Slc29a2_2
gcagcatccccgagtcggtg

SEQ ID NO: 55324 - DNA, 20 bp, Artificial Sequence
  sgRNA
  Slc29a2_3
tctgggcatccacgccacct

SEQ ID NO: 55325 - DNA, 20 bp, Artificial Sequence
  sgRNA
  Slc29a2_4
gatgaaccagacggacgcca

SEQ ID NO: 55326 - DNA, 20 bp, Artificial Sequence
  sgRNA
  Slc29a2_5
cggtaatgaagaagttccag

SEQ ID NO: 55327 - DNA, 20 bp, Artificial Sequence
  sgRNA
  Slc29a2_6
gcatgaagagtgggacaaac

SEQ ID NO: 55328 - DNA, 20 bp, Artificial Sequence
  sgRNA
  Slc29a2_7
tgatggcaggaaagaccgac

SEQ ID NO: 55329 - DNA, 20 bp, Artificial Sequence
  sgRNA
  Slc29a2_8
tgactgtgaagaccaacaca

SEQ ID NO: 55330 - DNA, 20 bp, Artificial Sequence
  sgRNA
  Slc29a2_9
gcatcctgcctgaagatgat

SEQ ID NO: 55331 - DNA, 20 bp, Artificial Sequence
  sgRNA
  Slc29a2_10
ccagaatccgcaccgactcg

SEQ ID NO: 55332 - DNA, 20 bp, Artificial Sequence
  sgRNA
  Slc29a2_11
gctgcccatcatcttcaggc

SEQ ID NO: 55333 - DNA, 20 bp, Artificial Sequence
  sgRNA
  Slc29a2_12
ggcaggtgttgccacatgag

SEQ ID NO: 55334 - DNA, 20 bp, Artificial Sequence
  sgRNA
  Slc29a2_13
ctttgccctgacagcagcgt

SEQ ID NO: 55335 - DNA, 20 bp, Artificial Sequence
  sgRNA
  Slc29a2_14
agaagctgatcccaaccagg

SEQ ID NO: 55336 - DNA, 20 bp, Artificial Sequence
  sgRNA
  Slc29a2_15
ggtaacatacgatggagagg

SEQ ID NO: 55337 - DNA, 20 bp, Artificial Sequence
  sgRNA
  Slc29a2_16
gcggtaatgaagaagttcca

SEQ ID NO: 55338 - DNA, 20 bp, Artificial Sequence
  sgRNA
  Slc29a2_17
caaggacatgagcatagcaa

SEQ ID NO: 55339 - DNA, 20 bp, Artificial Sequence
  sgRNA
  Slc29a2_18
gcttctcggtcaggtagtaa

SEQ ID NO: 55340 - DNA, 20 bp, Artificial Sequence
  sgRNA
  Slc29a2_19
gagttgggctggcctgttgg

SEQ ID NO: 55341 - DNA, 20 bp, Artificial Sequence
  sgRNA
  Slc29a2_20
ctgctcttcgctgtttccaa

SEQ ID NO: 55342 - DNA, 20 bp, Artificial Sequence
  sgRNA
  Slc29a3_1
aatgatggccatgcacgcga

SEQ ID NO: 55343 - DNA, 20 bp, Artificial Sequence
  sgRNA
  Slc29a3_2
gggaaactgcgcagaacccg

SEQ ID NO: 55344 - DNA, 20 bp, Artificial Sequence
  sgRNA
  Slc29a3_3
caaggaagactgctgccatg

SEQ ID NO: 55345 - DNA, 20 bp, Artificial Sequence
  sgRNA
  Slc29a3_4
accagaaaacactcgaactg

SEQ ID NO: 55346 - DNA, 20 bp, Artificial Sequence
  sgRNA
  Slc29a3_5
accgagagaccaccagtccg

SEQ ID NO: 55347 - DNA, 20 bp, Artificial Sequence
  sgRNA
  Slc29a3_6
gccgcgctcacacttgacca

SEQ ID NO: 55348 - DNA, 20 bp, Artificial Sequence
  sgRNA
  Slc29a3_7
gcagtgacaaagaagttcca

SEQ ID NO: 55349 - DNA, 20 bp, Artificial Sequence
  sgRNA
  Slc29a3_8
gcactgggtagatgtccgac

SEQ ID NO: 55350 - DNA, 20 bp, Artificial Sequence
  sgRNA
  Slc29a3_9
cagtccatgcacaaaggcac

SEQ ID NO: 55351 - DNA, 20 bp, Artificial Sequence
  sgRNA
  Slc29a3_10
cggacagtgaggccagaaca

SEQ ID NO: 55352 - DNA, 20 bp, Artificial Sequence
  sgRNA
  Slc29a3_11
gtccgactggaaaagcacct

SEQ ID NO: 55353 - DNA, 20 bp, Artificial Sequence
  sgRNA
  Slc29a3_12
ctagccgtcttcttcaggat

SEQ ID NO: 55354 - DNA, 20 bp, Artificial Sequence
  sgRNA
  Slc29a3_13
gtgcatggactggatattgg

SEQ ID NO: 55355 - DNA, 20 bp, Artificial Sequence
  sgRNA
  Slc29a3_14
aatatccagtccatgcacaa

SEQ ID NO: 55356 - DNA, 20 bp, Artificial Sequence
  sgRNA
  Slc29a3_15
ctaacttcctgcttgtcaac

SEQ ID NO: 55357 - DNA, 20 bp, Artificial Sequence
  sgRNA
  Slc29a3_16
gatacttcctcctggacccg

SEQ ID NO: 55358 - DNA, 20 bp, Artificial Sequence
  sgRNA
  Slc29a3_17
gaagaagcctcgggtccagg

SEQ ID NO: 55359 - DNA, 20 bp, Artificial Sequence
  sgRNA
  Slc29a3_18
cctaggagcaagctgctccc

SEQ ID NO: 55360 - DNA, 20 bp, Artificial Sequence
  sgRNA
  Slc29a3_19
agatgagcaccagcgtgctg

SEQ ID NO: 55361 - DNA, 20 bp, Artificial Sequence
  sgRNA
  Slc29a3_20
agtagttctagaaacacaca

SEQ ID NO: 55362 - DNA, 20 bp, Artificial Sequence
  sgRNA
  Slc29a4_1
gctgttgcaccgatacgtcg

SEQ ID NO: 55363 - DNA, 20 bp, Artificial Sequence
  sgRNA
  Slc29a4_2
actgcccaagaggtacacgc

SEQ ID NO: 55364 - DNA, 20 bp, Artificial Sequence
  sgRNA
  Slc29a4_3
gtggtgaagatagtcgacat

SEQ ID NO: 55365 - DNA, 20 bp, Artificial Sequence
  sgRNA
  Slc29a4_4
tgtgctcctaaacaacgttg

SEQ ID NO: 55366 - DNA, 20 bp, Artificial Sequence
  sgRNA
  Slc29a4_5
tgacccgcgccacgacgtat

SEQ ID NO: 55367 - DNA, 20 bp, Artificial Sequence
  sgRNA
  Slc29a4_6
gacgtatcggtgcaacagca

SEQ ID NO: 55368 - DNA, 20 bp, Artificial Sequence
  sgRNA
  Slc29a4_7
tagctttgacaacttccagc

SEQ ID NO: 55369 - DNA, 20 bp, Artificial Sequence
  sgRNA
  Slc29a4_8
cttcgtttgactcgtggccg

SEQ ID NO: 55370 - DNA, 20 bp, Artificial Sequence
  sgRNA
  Slc29a4_9
gcacagccgccaatgccacc

SEQ ID NO: 55371 - DNA, 20 bp, Artificial Sequence
  sgRNA
  Slc29a4_10
aatgaagtaggttaccgcaa

SEQ ID NO: 55372 - DNA, 20 bp, Artificial Sequence
  sgRNA
  Slc29a4_11
ggttgaacacggccatcacc

SEQ ID NO: 55373 - DNA, 20 bp, Artificial Sequence
  sgRNA
  Slc29a4_12
ttatcagcatatgcgatgtg

SEQ ID NO: 55374 - DNA, 20 bp, Artificial Sequence
  sgRNA
  Slc29a4_13
tgtgtcttctcgctgctaat

SEQ ID NO: 55375 - DNA, 20 bp, Artificial Sequence
  sgRNA
  Slc29a4_14
ccagctggagacgacagcag

SEQ ID NO: 55376 - DNA, 20 bp, Artificial Sequence
  sgRNA
  Slc29a4_15
gagcctcacctatatcctgg

SEQ ID NO: 55377 - DNA, 20 bp, Artificial Sequence
  sgRNA
  Slc29a4_16
cctctgctgtcgtctccagc

SEQ ID NO: 55378 - DNA, 20 bp, Artificial Sequence
  sgRNA
  Slc29a4_17
gctcatgtcaaatacgatgg

SEQ ID NO: 55379 - DNA, 20 bp, Artificial Sequence
  sgRNA
  Slc29a4_18
tgactgtgtcctacatgtcg

SEQ ID NO: 55380 - DNA, 20 bp, Artificial Sequence
  sgRNA
  Slc29a4_19
ctgcccaagaggtacacgca

SEQ ID NO: 55381 - DNA, 20 bp, Artificial Sequence
  sgRNA
  Slc29a4_20
gatggagtcgttggcggcgg

SEQ ID NO: 55382 - DNA, 20 bp, Artificial Sequence
  sgRNA
  Slc2a1_1
cctgctcatcaatcgtaacg

SEQ ID NO: 55383 - DNA, 20 bp, Artificial Sequence
  sgRNA
  Slc2a1_2
tcagcatggagttccgcctg

SEQ ID NO: 55384 - DNA, 20 bp, Artificial Sequence
  sgRNA
  Slc2a1_3
gtgtcacctacagctctacg

SEQ ID NO: 55385 - DNA, 20 bp, Artificial Sequence
  sgRNA
  Slc2a1_4
caaacatggaaccaccgcta

SEQ ID NO: 55386 - DNA, 20 bp, Artificial Sequence
  sgRNA
  Slc2a1_5
ggatgggctctccgtagcgg

SEQ ID NO: 55387 - DNA, 20 bp, Artificial Sequence
  sgRNA
  Slc2a1_6
gatcgcttccggcttccggc

SEQ ID NO: 55388 - DNA, 20 bp, Artificial Sequence
  sgRNA
  Slc2a1_7
ccaaagtgacaagacacccg

SEQ ID NO: 55389 - DNA, 20 bp, Artificial Sequence
  sgRNA
  Slc2a1_8
tgtgctcatgaccatcgccc

SEQ ID NO: 55390 - DNA, 20 bp, Artificial Sequence
  sgRNA
  Slc2a1_9
cgattgatgagcaggaagcg

SEQ ID NO: 55391 - DNA, 20 bp, Artificial Sequence
  sgRNA
  Slc2a1_10
gattgatgagcaggaagcgg

SEQ ID NO: 55392 - DNA, 20 bp, Artificial Sequence
  sgRNA
  Slc2a1_11
gatggccacgatgctcagat

SEQ ID NO: 55393 - DNA, 20 bp, Artificial Sequence
  sgRNA
  Slc2a1_12
tgaaccatggaataggacca

SEQ ID NO: 55394 - DNA, 20 bp, Artificial Sequence
  sgRNA
  Slc2a1_13
ctgcagttcggctataacac

SEQ ID NO: 55395 - DNA, 20 bp, Artificial Sequence
  sgRNA
  Slc2a1_14
ctgcaggtctcgggtcacat

SEQ ID NO: 55396 - DNA, 20 bp, Artificial Sequence
  sgRNA
  Slc2a1_15
gagccgatggtggcgtacac

SEQ ID NO: 55397 - DNA, 20 bp, Artificial Sequence
  sgRNA
  Slc2a1_16
gccggaagcgatctcatcga

SEQ ID NO: 55398 - DNA, 20 bp, Artificial Sequence
  sgRNA
  Slc2a1_17
ccacagcaatagcagcagga

SEQ ID NO: 55399 - DNA, 20 bp, Artificial Sequence
  sgRNA
  Slc2a1_18
gtgaagatgatgaagacgta

SEQ ID NO: 55400 - DNA, 20 bp, Artificial Sequence
  sgRNA
  Slc2a1_19
atcctgggccgcttcatcat

SEQ ID NO: 55401 - DNA, 20 bp, Artificial Sequence
  sgRNA
  Slc2a1_20
tggccgagctgttcagccag

SEQ ID NO: 55402 - DNA, 20 bp, Artificial Sequence
  sgRNA
  Slc2a10_1
cagccccgtggcgaccaagg

SEQ ID NO: 55403 - DNA, 20 bp, Artificial Sequence
  sgRNA
  Slc2a10_2
agaggcgtaatacagcacat

SEQ ID NO: 55404 - DNA, 20 bp, Artificial Sequence
  sgRNA
  Slc2a10_3
tgtgctggtgtccctctacg

SEQ ID NO: 55405 - DNA, 20 bp, Artificial Sequence
  sgRNA
  Slc2a10_4
agccaacagataaacggccc

SEQ ID NO: 55406 - DNA, 20 bp, Artificial Sequence
  sgRNA
  Slc2a10_5
ctctccctcggatctccgct

SEQ ID NO: 55407 - DNA, 20 bp, Artificial Sequence
  sgRNA
  Slc2a10_6
gcaggagacgagccatccta

SEQ ID NO: 55408 - DNA, 20 bp, Artificial Sequence
  sgRNA
  Slc2a10_7
tctacccagcggagatccga

SEQ ID NO: 55409 - DNA, 20 bp, Artificial Sequence
  sgRNA
  Slc2a10_8
cttctgcagcagcttcaact

SEQ ID NO: 55410 - DNA, 20 bp, Artificial Sequence
  sgRNA
  Slc2a10_9
gcacagctgaggagcccccg

SEQ ID NO: 55411 - DNA, 20 bp, Artificial Sequence
  sgRNA
  Slc2a10_10
ctaccactccagctgaactt

SEQ ID NO: 55412 - DNA, 20 bp, Artificial Sequence
  sgRNA
  Slc2a10_11
ttacggcctcaactacgtcc

SEQ ID NO: 55413 - DNA, 20 bp, Artificial Sequence
  sgRNA
  Slc2a10_12
tcgctccgttggcttccacg

SEQ ID NO: 55414 - DNA, 20 bp, Artificial Sequence
  sgRNA
  Slc2a10_13
ctgccaccttggtcgccacg

SEQ ID NO: 55415 - DNA, 20 bp, Artificial Sequence
  sgRNA
  Slc2a10_14
ctctccttcctcgacctgat

SEQ ID NO: 55416 - DNA, 20 bp, Artificial Sequence
  sgRNA
  Slc2a10_15
agtgatgcccacctcgtaga

SEQ ID NO: 55417 - DNA, 20 bp, Artificial Sequence
  sgRNA
  Slc2a10_16
ggagcccccgtggaagccaa

SEQ ID NO: 55418 - DNA, 20 bp, Artificial Sequence
  sgRNA
  Slc2a10_17
aacggagcgaaagatggtag

SEQ ID NO: 55419 - DNA, 20 bp, Artificial Sequence
  sgRNA
  Slc2a10_18
gttcagctggagtggtagga

SEQ ID NO: 55420 - DNA, 20 bp, Artificial Sequence
  sgRNA
  Slc2a10_19
gccccccagcaaagacacag

SEQ ID NO: 55421 - DNA, 20 bp, Artificial Sequence
  sgRNA
  Slc2a10_20
tgcacggtccaccagccccg

SEQ ID NO: 55422 - DNA, 20 bp, Artificial Sequence
  sgRNA
  Slc2a12_1
ttccgcaatgtacacacacg

SEQ ID NO: 55423 - DNA, 20 bp, Artificial Sequence
  sgRNA
  Slc2a12_2
aatcctgataggtctgacac

SEQ ID NO: 55424 - DNA, 20 bp, Artificial Sequence
  sgRNA
  Slc2a12_3
tcttcttaaccagtccctgg

SEQ ID NO: 55425 - DNA, 20 bp, Artificial Sequence
  sgRNA
  Slc2a12_4
caagttcataacccaccagg

SEQ ID NO: 55426 - DNA, 20 bp, Artificial Sequence
  sgRNA
  Slc2a12_5
gcgcggcctctaattccacc

SEQ ID NO: 55427 - DNA, 20 bp, Artificial Sequence
  sgRNA
  Slc2a12_6
atagaacacaaactcctcca

SEQ ID NO: 55428 - DNA, 20 bp, Artificial Sequence
  sgRNA
  Slc2a12_7
tcacggaggagccaatacag

SEQ ID NO: 55429 - DNA, 20 bp, Artificial Sequence
  sgRNA
  Slc2a12_8
agaatcactccctacagcaa

SEQ ID NO: 55430 - DNA, 20 bp, Artificial Sequence
  sgRNA
  Slc2a12_9
cctacacgctccttataatg

SEQ ID NO: 55431 - DNA, 20 bp, Artificial Sequence
  sgRNA
  Slc2a12_10
ctgacatctagcatgaactg

SEQ ID NO: 55432 - DNA, 20 bp, Artificial Sequence
  sgRNA
  Slc2a12_11
tagtatgtttggctgcccag

SEQ ID NO: 55433 - DNA, 20 bp, Artificial Sequence
  sgRNA
  Slc2a12_12
attgcttgcagaactcccag

SEQ ID NO: 55434 - DNA, 20 bp, Artificial Sequence
  sgRNA
  Slc2a12_13
tctgttactgcagccatcag

SEQ ID NO: 55435 - DNA, 20 bp, Artificial Sequence
  sgRNA
  Slc2a12_14
ggctccatgccattccccat

SEQ ID NO: 55436 - DNA, 20 bp, Artificial Sequence
  sgRNA
  Slc2a12_15
gccaatgtggtccacaagga

SEQ ID NO: 55437 - DNA, 20 bp, Artificial Sequence
  sgRNA
  Slc2a12_16
ctgagccgaactgaacacca

SEQ ID NO: 55438 - DNA, 20 bp, Artificial Sequence
  sgRNA
  Slc2a12_17
ggcgtgctcatagacaggta

SEQ ID NO: 55439 - DNA, 20 bp, Artificial Sequence
  sgRNA
  Slc2a12_18
gttgtgagttccctcctcat

SEQ ID NO: 55440 - DNA, 20 bp, Artificial Sequence
  sgRNA
  Slc2a12_19
tattgcttgcagaactccca

SEQ ID NO: 55441 - DNA, 20 bp, Artificial Sequence
  sgRNA
  Slc2a12_20
gatcaaagtgagttcttcag

SEQ ID NO: 55442 - DNA, 20 bp, Artificial Sequence
  sgRNA
  Slc2a13_1
catggcccccgacaccacgc

SEQ ID NO: 55443 - DNA, 20 bp, Artificial Sequence
  sgRNA
  Slc2a13_2
cctcggtggctgattcagaa

SEQ ID NO: 55444 - DNA, 20 bp, Artificial Sequence
  sgRNA
  Slc2a13_3
cacatcccacaactaacgct

SEQ ID NO: 55445 - DNA, 20 bp, Artificial Sequence
  sgRNA
  Slc2a13_4
aaggataatcagtgctactg

SEQ ID NO: 55446 - DNA, 20 bp, Artificial Sequence
  sgRNA
  Slc2a13_5
gttcggctacgacaccggcg

SEQ ID NO: 55447 - DNA, 20 bp, Artificial Sequence
  sgRNA
  Slc2a13_6
gatagttgcttcccttcacg

SEQ ID NO: 55448 - DNA, 20 bp, Artificial Sequence
  sgRNA
  Slc2a13_7
ggagcattcttcctctacgc

SEQ ID NO: 55449 - DNA, 20 bp, Artificial Sequence
  sgRNA
  Slc2a13_8
cgtgcccgtgtacatcgcgg

SEQ ID NO: 55450 - DNA, 20 bp, Artificial Sequence
  sgRNA
  Slc2a13_9
gttggtctaaaagtgacccg

SEQ ID NO: 55451 - DNA, 20 bp, Artificial Sequence
  sgRNA
  Slc2a13_10
catctgggacaaaattcggc

SEQ ID NO: 55452 - DNA, 20 bp, Artificial Sequence
  sgRNA
  Slc2a13_11
gtctggctcgtcgagaaagt

SEQ ID NO: 55453 - DNA, 20 bp, Artificial Sequence
  sgRNA
  Slc2a13_12
ctaacgctcggcgagttggg

SEQ ID NO: 55454 - DNA, 20 bp, Artificial Sequence
  sgRNA
  Slc2a13_13
cagcgtctccttgttggcgg

SEQ ID NO: 55455 - DNA, 20 bp, Artificial Sequence
  sgRNA
  Slc2a13_14
gcgcagcctgagcagcctga

SEQ ID NO: 55456 - DNA, 20 bp, Artificial Sequence
  sgRNA
  Slc2a13_15
ggatcaaaataccacctgca

SEQ ID NO: 55457 - DNA, 20 bp, Artificial Sequence
  sgRNA
  Slc2a13_16
gaccccggccttcgtgtacg

SEQ ID NO: 55458 - DNA, 20 bp, Artificial Sequence
  sgRNA
  Slc2a13_17
cagcggcgaatccggcgtag

SEQ ID NO: 55459 - DNA, 20 bp, Artificial Sequence
  sgRNA
  Slc2a13_18
aagtctgtcatcttccacgc

SEQ ID NO: 55460 - DNA, 20 bp, Artificial Sequence
  sgRNA
  Slc2a13_19
gttccagcgcgacgagaccc

SEQ ID NO: 55461 - DNA, 20 bp, Artificial Sequence
  sgRNA
  Slc2a13_20
tctacaactgaagcagcctg

SEQ ID NO: 55462 - DNA, 20 bp, Artificial Sequence
  sgRNA
  Slc2a2_1
agagggctccagtcaatgag

SEQ ID NO: 55463 - DNA, 20 bp, Artificial Sequence
  sgRNA
  Slc2a2_2
ttaccgacagcccatcctcg

SEQ ID NO: 55464 - DNA, 20 bp, Artificial Sequence
  sgRNA
  Slc2a2_3
ggactggttccaatgtacat

SEQ ID NO: 55465 - DNA, 20 bp, Artificial Sequence
  sgRNA
  Slc2a2_4
tgtgatcaatgcacctcaag

SEQ ID NO: 55466 - DNA, 20 bp, Artificial Sequence
  sgRNA
  Slc2a2_5
tgtgcagcatcagcgccacg

SEQ ID NO: 55467 - DNA, 20 bp, Artificial Sequence
  sgRNA
  Slc2a2_6
gattgcccagaataaagctg

SEQ ID NO: 55468 - DNA, 20 bp, Artificial Sequence
  sgRNA
  Slc2a2_7
gtactgagttccttccagtt

SEQ ID NO: 55469 - DNA, 20 bp, Artificial Sequence
  sgRNA
  Slc2a2_8
atttgtacagcagctttgcg

SEQ ID NO: 55470 - DNA, 20 bp, Artificial Sequence
  sgRNA
  Slc2a2_9
ttccagttcggctatgacat

SEQ ID NO: 55471 - DNA, 20 bp, Artificial Sequence
  sgRNA
  Slc2a2_10
acaccaatggttgcatacac

SEQ ID NO: 55472 - DNA, 20 bp, Artificial Sequence
  sgRNA
  Slc2a2_11
tttggaacatcccatcaaga

SEQ ID NO: 55473 - DNA, 20 bp, Artificial Sequence
  sgRNA
  Slc2a2_12
ccaggaccaccccagcgaag

SEQ ID NO: 55474 - DNA, 20 bp, Artificial Sequence
  sgRNA
  Slc2a2_13
gatgtcatagccgaactgga

SEQ ID NO: 55475 - DNA, 20 bp, Artificial Sequence
  sgRNA
  Slc2a2_14
gcaaccatgaaccaagggat

SEQ ID NO: 55476 - DNA, 20 bp, Artificial Sequence
  sgRNA
  Slc2a2_15
gttgatggccccaacaccaa

SEQ ID NO: 55477 - DNA, 20 bp, Artificial Sequence
  sgRNA
  Slc2a2_16
gcagaattccggaagaagag

SEQ ID NO: 55478 - DNA, 20 bp, Artificial Sequence
  sgRNA
  Slc2a2_17
atacacaacaccagctccct

SEQ ID NO: 55479 - DNA, 20 bp, Artificial Sequence
  sgRNA
  Slc2a2_18
gcagctttccggtcatccag

SEQ ID NO: 55480 - DNA, 20 bp, Artificial Sequence
  sgRNA
  Slc2a2_19
tgcaccatcttcatgtcggt

SEQ ID NO: 55481 - DNA, 20 bp, Artificial Sequence
  sgRNA
  Slc2a2_20
gcaaacagcctctcattgac

SEQ ID NO: 55482 - DNA, 20 bp, Artificial Sequence
  sgRNA
  Slc2a4_1
gcagcctctgatcatcgcag

SEQ ID NO: 55483 - DNA, 20 bp, Artificial Sequence
  sgRNA
  Slc2a4_2
aacagagctacaatgcaacg

SEQ ID NO: 55484 - DNA, 20 bp, Artificial Sequence
  sgRNA
  Slc2a4_3
aaccagaatgccaatgacga

SEQ ID NO: 55485 - DNA, 20 bp, Artificial Sequence
  sgRNA
  Slc2a4_4
ccaggtctaaagcgcctgac

SEQ ID NO: 55486 - DNA, 20 bp, Artificial Sequence
  sgRNA
  Slc2a4_5
gagtatctcataggaggccg

SEQ ID NO: 55487 - DNA, 20 bp, Artificial Sequence
  sgRNA
  Slc2a4_6
gatgatcagaggctgccggt

SEQ ID NO: 55488 - DNA, 20 bp, Artificial Sequence
  sgRNA
  Slc2a4_7
catgggcctagccaatgccg

SEQ ID NO: 55489 - DNA, 20 bp, Artificial Sequence
  sgRNA
  Slc2a4_8
agatctcagctgccttccga

SEQ ID NO: 55490 - DNA, 20 bp, Artificial Sequence
  sgRNA
  Slc2a4_9
gagagcccagagcgtagtga

SEQ ID NO: 55491 - DNA, 20 bp, Artificial Sequence
  sgRNA
  Slc2a4_10
ggtttccagtatgttgcggt

SEQ ID NO: 55492 - DNA, 20 bp, Artificial Sequence
  sgRNA
  Slc2a4_11
tagtagaacgagctggacga

SEQ ID NO: 55493 - DNA, 20 bp, Artificial Sequence
  sgRNA
  Slc2a4_12
gtacagaacttgaatactta

SEQ ID NO: 55494 - DNA, 20 bp, Artificial Sequence
  sgRNA
  Slc2a4_13
gcagcgagtgactggaacac

SEQ ID NO: 55495 - DNA, 20 bp, Artificial Sequence
  sgRNA
  Slc2a4_14
atgagatactcattcttgga

SEQ ID NO: 55496 - DNA, 20 bp, Artificial Sequence
  sgRNA
  Slc2a4_15
gcacagctgagaatacagct

SEQ ID NO: 55497 - DNA, 20 bp, Artificial Sequence
  sgRNA
  Slc2a4_16
ctgtgccatcttgatgaccg

SEQ ID NO: 55498 - DNA, 20 bp, Artificial Sequence
  sgRNA
  Slc2a4_17
tccagtcactcgctgccgag

SEQ ID NO: 55499 - DNA, 20 bp, Artificial Sequence
  sgRNA
  Slc2a4_18
ctaaaagggaaggtgtccgt

SEQ ID NO: 55500 - DNA, 20 bp, Artificial Sequence
  sgRNA
  Slc2a4_19
agtccctgaccagacagtga

SEQ ID NO: 55501 - DNA, 20 bp, Artificial Sequence
  sgRNA
  Slc2a4_20
tgtaacttcattgtcggcat

SEQ ID NO: 55502 - DNA, 20 bp, Artificial Sequence
  sgRNA
  Slc2a5_1
ctggccccgaaaaacctacg

SEQ ID NO: 55503 - DNA, 20 bp, Artificial Sequence
  sgRNA
  Slc2a5_2
tgcgctgaggtagatctgat

SEQ ID NO: 55504 - DNA, 20 bp, Artificial Sequence
  sgRNA
  Slc2a5_3
cctgcccagtttattcacca

SEQ ID NO: 55505 - DNA, 20 bp, Artificial Sequence
  sgRNA
  Slc2a5_4
cggggactccagttagaccc

SEQ ID NO: 55506 - DNA, 20 bp, Artificial Sequence
  sgRNA
  Slc2a5_5
atggtcgtcccagagaccaa

SEQ ID NO: 55507 - DNA, 20 bp, Artificial Sequence
  sgRNA
  Slc2a5_6
ccagccgcctacatgatcgg

SEQ ID NO: 55508 - DNA, 20 bp, Artificial Sequence
  sgRNA
  Slc2a5_7
actgcctccgatcatgtagg

SEQ ID NO: 55509 - DNA, 20 bp, Artificial Sequence
  sgRNA
  Slc2a5_8
ggccccgaaaaacctacgag

SEQ ID NO: 55510 - DNA, 20 bp, Artificial Sequence
  sgRNA
  Slc2a5_9
gatcagatctacctcagcgc

SEQ ID NO: 55511 - DNA, 20 bp, Artificial Sequence
  sgRNA
  Slc2a5_10
cggcgattcctactcctcgt

SEQ ID NO: 55512 - DNA, 20 bp, Artificial Sequence
  sgRNA
  Slc2a5_11
tggccccgaaaaacctacga

SEQ ID NO: 55513 - DNA, 20 bp, Artificial Sequence
  sgRNA
  Slc2a5_12
ccagctcccctaagtacata

SEQ ID NO: 55514 - DNA, 20 bp, Artificial Sequence
  sgRNA
  Slc2a5_13
agacgtatatccgaagaagg

SEQ ID NO: 55515 - DNA, 20 bp, Artificial Sequence
  sgRNA
  Slc2a5_14
agcccattaagatggccggc

SEQ ID NO: 55516 - DNA, 20 bp, Artificial Sequence
  sgRNA
  Slc2a5_15
ccactcccagagcccctcgt

SEQ ID NO: 55517 - DNA, 20 bp, Artificial Sequence
  sgRNA
  Slc2a5_16
tcagcactaagcaggctatg

SEQ ID NO: 55518 - DNA, 20 bp, Artificial Sequence
  sgRNA
  Slc2a5_17
gcaaagataatgaagctgta

SEQ ID NO: 55519 - DNA, 20 bp, Artificial Sequence
  sgRNA
  Slc2a5_18
cgtggtccctatgtacttag

SEQ ID NO: 55520 - DNA, 20 bp, Artificial Sequence
  sgRNA
  Slc2a5_19
ccgacagtgatgaagagttg

SEQ ID NO: 55521 - DNA, 20 bp, Artificial Sequence
  sgRNA
  Slc2a5_20
tcttctggatcagcaggtag

SEQ ID NO: 55522 - DNA, 20 bp, Artificial Sequence
  sgRNA
  Slc2a6_1
gagtagccgagtgtcgtggg

SEQ ID NO: 55523 - DNA, 20 bp, Artificial Sequence
  sgRNA
  Slc2a6_2
gagagacagggatccaaaca

SEQ ID NO: 55524 - DNA, 20 bp, Artificial Sequence
  sgRNA
  Slc2a6_3
catcttcgacaacacatccg

SEQ ID NO: 55525 - DNA, 20 bp, Artificial Sequence
  sgRNA
  Slc2a6_4
actacacctggacaaaatcc

SEQ ID NO: 55526 - DNA, 20 bp, Artificial Sequence
  sgRNA
  Slc2a6_5
gccacaccacgggcacgcaa

SEQ ID NO: 55527 - DNA, 20 bp, Artificial Sequence
  sgRNA
  Slc2a6_6
ctctttgagagcaagaagcg

SEQ ID NO: 55528 - DNA, 20 bp, Artificial Sequence
  sgRNA
  Slc2a6_7
cctcgatctgctccagcgag

SEQ ID NO: 55529 - DNA, 20 bp, Artificial Sequence
  sgRNA
  Slc2a6_8
ggtatcatagtcgagtccct

SEQ ID NO: 55530 - DNA, 20 bp, Artificial Sequence
  sgRNA
  Slc2a6_9
gaacccctgctaagaaccga

SEQ ID NO: 55531 - DNA, 20 bp, Artificial Sequence
  sgRNA
  Slc2a6_10
agcagatccaggacaacgtg

SEQ ID NO: 55532 - DNA, 20 bp, Artificial Sequence
  sgRNA
  Slc2a6_11
tccccaacagaagcatccag

SEQ ID NO: 55533 - DNA, 20 bp, Artificial Sequence
  sgRNA
  Slc2a6_12
gccacagcaagccatcgcca

SEQ ID NO: 55534 - DNA, 20 bp, Artificial Sequence
  sgRNA
  Slc2a6_13
gggcttccgcccacgacact

SEQ ID NO: 55535 - DNA, 20 bp, Artificial Sequence
  sgRNA
  Slc2a6_14
agatggtctgtaggtacacc

SEQ ID NO: 55536 - DNA, 20 bp, Artificial Sequence
  sgRNA
  Slc2a6_15
ggatctgctcaaactcccaa

SEQ ID NO: 55537 - DNA, 20 bp, Artificial Sequence
  sgRNA
  Slc2a6_16
gatgctgacgggctttgccg

SEQ ID NO: 55538 - DNA, 20 bp, Artificial Sequence
  sgRNA
  Slc2a6_17
ctcaaactcccaatggacct

SEQ ID NO: 55539 - DNA, 20 bp, Artificial Sequence
  sgRNA
  Slc2a6_18
cctcactaactacttcctgc

SEQ ID NO: 55540 - DNA, 20 bp, Artificial Sequence
  sgRNA
  Slc2a6_19
atgctgacgggctttgccgg

SEQ ID NO: 55541 - DNA, 20 bp, Artificial Sequence
  sgRNA
  Slc2a6_20
gttctgcccttgcgtgcccg

SEQ ID NO: 55542 - DNA, 20 bp, Artificial Sequence
  sgRNA
  Slc2a7_1
agtactcttcccatgtacct

SEQ ID NO: 55543 - DNA, 20 bp, Artificial Sequence
  sgRNA
  Slc2a7_2
tctcaatcagagtgtagcgg

SEQ ID NO: 55544 - DNA, 20 bp, Artificial Sequence
  sgRNA
  Slc2a7_3
ggcctgatggtcaataagtg

SEQ ID NO: 55545 - DNA, 20 bp, Artificial Sequence
  sgRNA
  Slc2a7_4
gagtacggacagacgaccct

SEQ ID NO: 55546 - DNA, 20 bp, Artificial Sequence
  sgRNA
  Slc2a7_5
gcagctgtccgggatcaacg

SEQ ID NO: 55547 - DNA, 20 bp, Artificial Sequence
  sgRNA
  Slc2a7_6
ttctcaatcagagtgtagcg

SEQ ID NO: 55548 - DNA, 20 bp, Artificial Sequence
  sgRNA
  Slc2a7_7
gctgctcctgtggtcttgca

SEQ ID NO: 55549 - DNA, 20 bp, Artificial Sequence
  sgRNA
  Slc2a7_8
gagcgcaccgagcaagccga

SEQ ID NO: 55550 - DNA, 20 bp, Artificial Sequence
  sgRNA
  Slc2a7_9
ggctcaccaacttcatcgtg

SEQ ID NO: 55551 - DNA, 20 bp, Artificial Sequence
  sgRNA
  Slc2a7_10
acggaggtattcgtcatcat

SEQ ID NO: 55552 - DNA, 20 bp, Artificial Sequence
  sgRNA
  Slc2a7_11
tctctgtcctcaccaccgag

SEQ ID NO: 55553 - DNA, 20 bp, Artificial Sequence
  sgRNA
  Slc2a7_12
ccccaaacgctctatgataa

SEQ ID NO: 55554 - DNA, 20 bp, Artificial Sequence
  sgRNA
  Slc2a7_13
agtgaaggcggctgtccgag

SEQ ID NO: 55555 - DNA, 20 bp, Artificial Sequence
  sgRNA
  Slc2a7_14
cttgctgactcccatcagga

SEQ ID NO: 55556 - DNA, 20 bp, Artificial Sequence
  sgRNA
  Slc2a7_15
ttgtccctaatgcaccccta

SEQ ID NO: 55557 - DNA, 20 bp, Artificial Sequence
  sgRNA
  Slc2a7_16
actggctccccagaacctta

SEQ ID NO: 55558 - DNA, 20 bp, Artificial Sequence
  sgRNA
  Slc2a7_17
atctctgtcctcaccaccga

SEQ ID NO: 55559 - DNA, 20 bp, Artificial Sequence
  sgRNA
  Slc2a7_18
gccagttctcccaggtacat

SEQ ID NO: 55560 - DNA, 20 bp, Artificial Sequence
  sgRNA
  Slc2a7_19
gtggtaatccctgaaaccaa

SEQ ID NO: 55561 - DNA, 20 bp, Artificial Sequence
  sgRNA
  Slc2a7_20
tgcattagggacaatgacgg

SEQ ID NO: 55562 - DNA, 20 bp, Artificial Sequence
  sgRNA
  Slc2a8_1
cctgcgcctcggagacaatg

SEQ ID NO: 55563 - DNA, 20 bp, Artificial Sequence
  sgRNA
  Slc2a8_2
acagcaaagccagtcacgaa

SEQ ID NO: 55564 - DNA, 20 bp, Artificial Sequence
  sgRNA
  Slc2a8_3
gattatgcccacagtgaccg

SEQ ID NO: 55565 - DNA, 20 bp, Artificial Sequence
  sgRNA
  Slc2a8_4
ttgagtgaggagaaaacgtg

SEQ ID NO: 55566 - DNA, 20 bp, Artificial Sequence
  sgRNA
  Slc2a8_5
gcttccggtggccgcaatag

SEQ ID NO: 55567 - DNA, 20 bp, Artificial Sequence
  sgRNA
  Slc2a8_6
gtgagccagaaggcaccgta

SEQ ID NO: 55568 - DNA, 20 bp, Artificial Sequence
  sgRNA
  Slc2a8_7
cactcaacaccagtaccagg

SEQ ID NO: 55569 - DNA, 20 bp, Artificial Sequence
  sgRNA
  Slc2a8_8
aggaggccgcattgtctccg

SEQ ID NO: 55570 - DNA, 20 bp, Artificial Sequence
  sgRNA
  Slc2a8_9
agcgcgaagccgaagctgag

SEQ ID NO: 55571 - DNA, 20 bp, Artificial Sequence
  sgRNA
  Slc2a8_10
agtcgcctcactagtggcac

SEQ ID NO: 55572 - DNA, 20 bp, Artificial Sequence
  sgRNA
  Slc2a8_11
gttggtgaggacacagatgc

SEQ ID NO: 55573 - DNA, 20 bp, Artificial Sequence
  sgRNA
  Slc2a8_12
acaccagtaccaggaggcca

SEQ ID NO: 55574 - DNA, 20 bp, Artificial Sequence
  sgRNA
  Slc2a8_13
catccacacatcccgggccg

SEQ ID NO: 55575 - DNA, 20 bp, Artificial Sequence
  sgRNA
  Slc2a8_14
cagctgctggaagaccatga

SEQ ID NO: 55576 - DNA, 20 bp, Artificial Sequence
  sgRNA
  Slc2a8_15
agagccccacaggaagcgca

SEQ ID NO: 55577 - DNA, 20 bp, Artificial Sequence
  sgRNA
  Slc2a8_16
caagtcacagcccatttcga

SEQ ID NO: 55578 - DNA, 20 bp, Artificial Sequence
  sgRNA
  Slc2a8_17
tggctttgctgtcatcaccg

SEQ ID NO: 55579 - DNA, 20 bp, Artificial Sequence
  sgRNA
  Slc2a8_18
agggaaatgccgatgatgag

SEQ ID NO: 55580 - DNA, 20 bp, Artificial Sequence
  sgRNA
  Slc2a8_19
gacaaccatcagctgcacac

SEQ ID NO: 55581 - DNA, 20 bp, Artificial Sequence
  sgRNA
  Slc2a8_20
ggtcttccagcagctgtcag

SEQ ID NO: 55582 - DNA, 20 bp, Artificial Sequence
  sgRNA
  Slc2a9_1
cggagaggttgtacccgtag

SEQ ID NO: 55583 - DNA, 20 bp, Artificial Sequence
  sgRNA
  Slc2a9_2
gcatgccatcagcaacgctg

SEQ ID NO: 55584 - DNA, 20 bp, Artificial Sequence
  sgRNA
  Slc2a9_3
ccaactatgtggactcaatg

SEQ ID NO: 55585 - DNA, 20 bp, Artificial Sequence
  sgRNA
  Slc2a9_4
tctcaacgagatctcaccca

SEQ ID NO: 55586 - DNA, 20 bp, Artificial Sequence
  sgRNA
  Slc2a9_5
cgtgcaaaggaacctccgcc

SEQ ID NO: 55587 - DNA, 20 bp, Artificial Sequence
  sgRNA
  Slc2a9_6
ctacgggtacaacctctccg

SEQ ID NO: 55588 - DNA, 20 bp, Artificial Sequence
  sgRNA
  Slc2a9_7
ggctctcaaacttcgccgta

SEQ ID NO: 55589 - DNA, 20 bp, Artificial Sequence
  sgRNA
  Slc2a9_8
gccaccggtgtcacacatca

SEQ ID NO: 55590 - DNA, 20 bp, Artificial Sequence
  sgRNA
  Slc2a9_9
acatagttggtagctggcca

SEQ ID NO: 55591 - DNA, 20 bp, Artificial Sequence
  sgRNA
  Slc2a9_10
attgtgggacggttcatcat

SEQ ID NO: 55592 - DNA, 20 bp, Artificial Sequence
  sgRNA
  Slc2a9_11
atctcacccaaggagatccg

SEQ ID NO: 55593 - DNA, 20 bp, Artificial Sequence
  sgRNA
  Slc2a9_12
tacatattgtggcgaagacg

SEQ ID NO: 55594 - DNA, 20 bp, Artificial Sequence
  sgRNA
  Slc2a9_13
gccatagctgtccagcgtgg

SEQ ID NO: 55595 - DNA, 20 bp, Artificial Sequence
  sgRNA
  Slc2a9_14
gacccacagagagctcccca

SEQ ID NO: 55596 - DNA, 20 bp, Artificial Sequence
  sgRNA
  Slc2a9_15
tgggcgcgttcaccacggag

SEQ ID NO: 55597 - DNA, 20 bp, Artificial Sequence
  sgRNA
  Slc2a9_16
acaatggaacctggtacagg

SEQ ID NO: 55598 - DNA, 20 bp, Artificial Sequence
  sgRNA
  Slc2a9_17
gagatctcgttgagatacat

SEQ ID NO: 55599 - DNA, 20 bp, Artificial Sequence
  sgRNA
  Slc2a9_18
ccgaagccaccaatgaggag

SEQ ID NO: 55600 - DNA, 20 bp, Artificial Sequence
  sgRNA
  Slc2a9_19
tgttcctcttggcaaatgcc

SEQ ID NO: 55601 - DNA, 20 bp, Artificial Sequence
  sgRNA
  Slc2a9_20
cacagaccagagcagagtca

SEQ ID NO: 55602 - DNA, 20 bp, Artificial Sequence
  sgRNA
  Slc30a1_1
tgggccagcgtcacgcatcg

SEQ ID NO: 55603 - DNA, 20 bp, Artificial Sequence
  sgRNA
  Slc30a1_2
ccaggaggagaccaacacgc

SEQ ID NO: 55604 - DNA, 20 bp, Artificial Sequence
  sgRNA
  Slc30a1_3
ggcattcacgaccacgatca

SEQ ID NO: 55605 - DNA, 20 bp, Artificial Sequence
  sgRNA
  Slc30a1_4
ggagtctgacaatctggaag

SEQ ID NO: 55606 - DNA, 20 bp, Artificial Sequence
  sgRNA
  Slc30a1_5
gtgcgcccatcacctcagcg

SEQ ID NO: 55607 - DNA, 20 bp, Artificial Sequence
  sgRNA
  Slc30a1_6
gccgaacgtgttcttctgcg

SEQ ID NO: 55608 - DNA, 20 bp, Artificial Sequence
  sgRNA
  Slc30a1_7
cggctcgatgaagcgctcga

SEQ ID NO: 55609 - DNA, 20 bp, Artificial Sequence
  sgRNA
  Slc30a1_8
gctgggcagctgaatatgcg

SEQ ID NO: 55610 - DNA, 20 bp, Artificial Sequence
  sgRNA
  Slc30a1_9
gttccaccatcacagcggcg

SEQ ID NO: 55611 - DNA, 20 bp, Artificial Sequence
  sgRNA
  Slc30a1_10
ccaacaccagcaattccaac

SEQ ID NO: 55612 - DNA, 20 bp, Artificial Sequence
  sgRNA
  Slc30a1_11
atctctacagacgatttgca

SEQ ID NO: 55613 - DNA, 20 bp, Artificial Sequence
  sgRNA
  Slc30a1_12
cgtggtgctgagcgtcggcg

SEQ ID NO: 55614 - DNA, 20 bp, Artificial Sequence
  sgRNA
  Slc30a1_13
taatctctatcaccacagca

SEQ ID NO: 55615 - DNA, 20 bp, Artificial Sequence
  sgRNA
  Slc30a1_14
gttcggctggatccgcgctg

SEQ ID NO: 55616 - DNA, 20 bp, Artificial Sequence
  sgRNA
  Slc30a1_15
tgtctgttccaccatcacag

SEQ ID NO: 55617 - DNA, 20 bp, Artificial Sequence
  sgRNA
  Slc30a1_16
gccaacaccagcaattccaa

SEQ ID NO: 55618 - DNA, 20 bp, Artificial Sequence
  sgRNA
  Slc30a1_17
agcgctcgacggcttccagc

SEQ ID NO: 55619 - DNA, 20 bp, Artificial Sequence
  sgRNA
  Slc30a1_18
ctaggtagagcacccagcat

SEQ ID NO: 55620 - DNA, 20 bp, Artificial Sequence
  sgRNA
  Slc30a1_19
tgaacgccatcttcctcacg

SEQ ID NO: 55621 - DNA, 20 bp, Artificial Sequence
  sgRNA
  Slc30a1_20
cagcctgaattcgctagcgt

SEQ ID NO: 55622 - DNA, 20 bp, Artificial Sequence
  sgRNA
  Slc31a1_1
tgtggttcatacccatatgg

SEQ ID NO: 55623 - DNA, 20 bp, Artificial Sequence
  sgRNA
  Slc31a1_2
ttggtaatcaatacacctgg

SEQ ID NO: 55624 - DNA, 20 bp, Artificial Sequence
  sgRNA
  Slc31a1_3
ggactcaagatagcccgaga

SEQ ID NO: 55625 - DNA, 20 bp, Artificial Sequence
  sgRNA
  Slc31a1_4
tcagcctcacactcccacgg

SEQ ID NO: 55626 - DNA, 20 bp, Artificial Sequence
  sgRNA
  Slc31a1_5
ctgctgctactgcaatgcat

SEQ ID NO: 55627 - DNA, 20 bp, Artificial Sequence
  sgRNA
  Slc31a1_6
ccatatgggtatgaaccaca

SEQ ID NO: 55628 - DNA, 20 bp, Artificial Sequence
  sgRNA
  Slc31a1_7
ggtttggtaatcaatacacc

SEQ ID NO: 55629 - DNA, 20 bp, Artificial Sequence
  sgRNA
  Slc31a1_8
tcatgctgtcccctccaccg

SEQ ID NO: 55630 - DNA, 20 bp, Artificial Sequence
  sgRNA
  Slc31a1_9
tatgcattgcagtagcagca

SEQ ID NO: 55631 - DNA, 20 bp, Artificial Sequence
  sgRNA
  Slc31a1_10
tcatcttcatgacctacaat

SEQ ID NO: 55632 - DNA, 20 bp, Artificial Sequence
  sgRNA
  Slc31a1_11
aggactcaagatagcccgag

SEQ ID NO: 55633 - DNA, 20 bp, Artificial Sequence
  sgRNA
  Slc31a1_12
cttcagctggaagaaggcag

SEQ ID NO: 55634 - DNA, 20 bp, Artificial Sequence
  sgRNA
  Slc31a1_13
atgcctgtcccaggaccaaa

SEQ ID NO: 55635 - DNA, 20 bp, Artificial Sequence
  sgRNA
  Slc31a1_14
tttgtgtgtctccattagga

SEQ ID NO: 55636 - DNA, 20 bp, Artificial Sequence
  sgRNA
  Slc31a1_15
tggtaatgttgtcgtccgtg

SEQ ID NO: 55637 - DNA, 20 bp, Artificial Sequence
  sgRNA
  Slc31a1_16
catgctgtcccctccaccgt

SEQ ID NO: 55638 - DNA, 20 bp, Artificial Sequence
  sgRNA
  Slc31a1_17
acctcagcctcacactccca

SEQ ID NO: 55639 - DNA, 20 bp, Artificial Sequence
  sgRNA
  Slc31a1_18
gcactgtctgcaggaggtgg

SEQ ID NO: 55640 - DNA, 20 bp, Artificial Sequence
  sgRNA
  Slc31a1_19
aggtgtattgattaccaaac

SEQ ID NO: 55641 - DNA, 20 bp, Artificial Sequence
  sgRNA
  Slc31a1_20
agaaatggctggagccttcg

SEQ ID NO: 55642 - DNA, 20 bp, Artificial Sequence
  sgRNA
  Slc32a1_1
gacgtgtatcttgtacgtcg

SEQ ID NO: 55643 - DNA, 20 bp, Artificial Sequence
  sgRNA
  Slc32a1_2
acaaacccaagatcacggcg

SEQ ID NO: 55644 - DNA, 20 bp, Artificial Sequence
  sgRNA
  Slc32a1_3
ggagacattcattatcagcg

SEQ ID NO: 55645 - DNA, 20 bp, Artificial Sequence
  sgRNA
  Slc32a1_4
cagcagactgaacttggaca

SEQ ID NO: 55646 - DNA, 20 bp, Artificial Sequence
  sgRNA
  Slc32a1_5
tctgcgccacattgaccacg

SEQ ID NO: 55647 - DNA, 20 bp, Artificial Sequence
  sgRNA
  Slc32a1_6
tcatgtacaacagtttcccg

SEQ ID NO: 55648 - DNA, 20 bp, Artificial Sequence
  sgRNA
  Slc32a1_7
ggcttcgtgcattcactcga

SEQ ID NO: 55649 - DNA, 20 bp, Artificial Sequence
  sgRNA
  Slc32a1_8
ccctacgccatcctccacgg

SEQ ID NO: 55650 - DNA, 20 bp, Artificial Sequence
  sgRNA
  Slc32a1_9
gtgtccagttcatcatgcag

SEQ ID NO: 55651 - DNA, 20 bp, Artificial Sequence
  sgRNA
  Slc32a1_10
gtacgaggagaacgaagacg

SEQ ID NO: 55652 - DNA, 20 bp, Artificial Sequence
  sgRNA
  Slc32a1_11
agatgatgaggaacaacccc

SEQ ID NO: 55653 - DNA, 20 bp, Artificial Sequence
  sgRNA
  Slc32a1_12
acttcgacggccgcgaagaa

SEQ ID NO: 55654 - DNA, 20 bp, Artificial Sequence
  sgRNA
  Slc32a1_13
gacattcattatcagcgcgg

SEQ ID NO: 55655 - DNA, 20 bp, Artificial Sequence
  sgRNA
  Slc32a1_14
cctcatcgcgtgcctgtacg

SEQ ID NO: 55656 - DNA, 20 bp, Artificial Sequence
  sgRNA
  Slc32a1_15
acggtcgccttaagtcctgg

SEQ ID NO: 55657 - DNA, 20 bp, Artificial Sequence
  sgRNA
  Slc32a1_16
tctgcgccctcgtctccgca

SEQ ID NO: 55658 - DNA, 20 bp, Artificial Sequence
  sgRNA
  Slc32a1_17
ggaagaggttgaccacggcg

SEQ ID NO: 55659 - DNA, 20 bp, Artificial Sequence
  sgRNA
  Slc32a1_18
atcgccgcctgcgtgctcaa

SEQ ID NO: 55660 - DNA, 20 bp, Artificial Sequence
  sgRNA
  Slc32a1_19
gccaccgatgaggaagcggt

SEQ ID NO: 55661 - DNA, 20 bp, Artificial Sequence
  sgRNA
  Slc32a1_20
tgcatgttgccttcgagaga

SEQ ID NO: 55662 - DNA, 20 bp, Artificial Sequence
  sgRNA
  Slc33a1_1
gtgacttacctaaagccccg

SEQ ID NO: 55663 - DNA, 20 bp, Artificial Sequence
  sgRNA
  Slc33a1_2
atgttatcccgggaaaacgt

SEQ ID NO: 55664 - DNA, 20 bp, Artificial Sequence
  sgRNA
  Slc33a1_3
gaaagggtaacgattcccct

SEQ ID NO: 55665 - DNA, 20 bp, Artificial Sequence
  sgRNA
  Slc33a1_4
aaatattgatggcagaacac

SEQ ID NO: 55666 - DNA, 20 bp, Artificial Sequence
  sgRNA
  Slc33a1_5
ttcggatctatagctccgcg

SEQ ID NO: 55667 - DNA, 20 bp, Artificial Sequence
  sgRNA
  Slc33a1_6
agttcggatctatagctccg

SEQ ID NO: 55668 - DNA, 20 bp, Artificial Sequence
  sgRNA
  Slc33a1_7
gggctttaggtaagtcacca

SEQ ID NO: 55669 - DNA, 20 bp, Artificial Sequence
  sgRNA
  Slc33a1_8
tctcccacaaggacagcagt

SEQ ID NO: 55670 - DNA, 20 bp, Artificial Sequence
  sgRNA
  Slc33a1_9
aagtagacggcatcaaccaa

SEQ ID NO: 55671 - DNA, 20 bp, Artificial Sequence
  sgRNA
  Slc33a1_10
actcaagtggaccgtttgct

SEQ ID NO: 55672 - DNA, 20 bp, Artificial Sequence
  sgRNA
  Slc33a1_11
gtaagtgtctgtgatccctt

SEQ ID NO: 55673 - DNA, 20 bp, Artificial Sequence
  sgRNA
  Slc33a1_12
ctgtcatcccagccgcccgg

SEQ ID NO: 55674 - DNA, 20 bp, Artificial Sequence
  sgRNA
  Slc33a1_13
ttatctgcagagggaccatt

SEQ ID NO: 55675 - DNA, 20 bp, Artificial Sequence
  sgRNA
  Slc33a1_14
gcttcgacatgcaattctgt

SEQ ID NO: 55676 - DNA, 20 bp, Artificial Sequence
  sgRNA
  Slc33a1_15
tagtaaaagaagagacccaa

SEQ ID NO: 55677 - DNA, 20 bp, Artificial Sequence
  sgRNA
  Slc33a1_16
acaaggacagcagtcggcag

SEQ ID NO: 55678 - DNA, 20 bp, Artificial Sequence
  sgRNA
  Slc33a1_17
aggacagcagtcggcagcgg

SEQ ID NO: 55679 - DNA, 20 bp, Artificial Sequence
  sgRNA
  Slc33a1_18
cctaaagtagagcatcaagg

SEQ ID NO: 55680 - DNA, 20 bp, Artificial Sequence
  sgRNA
  Slc33a1_19
gtaacgattcccctgggttg

SEQ ID NO: 55681 - DNA, 20 bp, Artificial Sequence
  sgRNA
  Slc33a1_20
gtggcaggattatctgcaga

SEQ ID NO: 55682 - DNA, 20 bp, Artificial Sequence
  sgRNA
  Slc34a1_1
agttgagcatcttcacaagg

SEQ ID NO: 55683 - DNA, 20 bp, Artificial Sequence
  sgRNA
  Slc34a1_2
tgacccactacctaccaagc

SEQ ID NO: 55684 - DNA, 20 bp, Artificial Sequence
  sgRNA
  Slc34a1_3
gtgtcacccagacacaacag

SEQ ID NO: 55685 - DNA, 20 bp, Artificial Sequence
  sgRNA
  Slc34a1_4
tgccatcctatccaacccag

SEQ ID NO: 55686 - DNA, 20 bp, Artificial Sequence
  sgRNA
  Slc34a1_5
ggttggcacgaagctcctga

SEQ ID NO: 55687 - DNA, 20 bp, Artificial Sequence
  sgRNA
  Slc34a1_6
gctgtcccagaagcttgccc

SEQ ID NO: 55688 - DNA, 20 bp, Artificial Sequence
  sgRNA
  Slc34a1_7
gttgcttccttcaacatccg

SEQ ID NO: 55689 - DNA, 20 bp, Artificial Sequence
  sgRNA
  Slc34a1_8
ggtagaggacagcaaaccag

SEQ ID NO: 55690 - DNA, 20 bp, Artificial Sequence
  sgRNA
  Slc34a1_9
gctcaatgctgatcacaccc

SEQ ID NO: 55691 - DNA, 20 bp, Artificial Sequence
  sgRNA
  Slc34a1_10
aatgagactgtgattcctca

SEQ ID NO: 55692 - DNA, 20 bp, Artificial Sequence
  sgRNA
  Slc34a1_11
ggcggagctgagcacatcca

SEQ ID NO: 55693 - DNA, 20 bp, Artificial Sequence
  sgRNA
  Slc34a1_12
gctcagctccgccttccagt

SEQ ID NO: 55694 - DNA, 20 bp, Artificial Sequence
  sgRNA
  Slc34a1_13
tgcaaagagtgcatccagcg

SEQ ID NO: 55695 - DNA, 20 bp, Artificial Sequence
  sgRNA
  Slc34a1_14
cctcagggactcatccccca

SEQ ID NO: 55696 - DNA, 20 bp, Artificial Sequence
  sgRNA
  Slc34a1_15
cagccttgcaaacaccacca

SEQ ID NO: 55697 - DNA, 20 bp, Artificial Sequence
  sgRNA
  Slc34a1_16
atgttggagcccatgatgat

SEQ ID NO: 55698 - DNA, 20 bp, Artificial Sequence
  sgRNA
  Slc34a1_17
tcagccatcaccccactcat

SEQ ID NO: 55699 - DNA, 20 bp, Artificial Sequence
  sgRNA
  Slc34a1_18
cttgtgataaggccatccag

SEQ ID NO: 55700 - DNA, 20 bp, Artificial Sequence
  sgRNA
  Slc34a1_19
gggcctggcataacacaagg

SEQ ID NO: 55701 - DNA, 20 bp, Artificial Sequence
  sgRNA
  Slc34a1_20
acaagtgcagagaaccacca

SEQ ID NO: 55702 - DNA, 20 bp, Artificial Sequence
  sgRNA
  Slc34a2_1
tcatagaggagcatcccgag

SEQ ID NO: 55703 - DNA, 20 bp, Artificial Sequence
  sgRNA
  Slc34a2_2
ctccatcaccaacacgatcg

SEQ ID NO: 55704 - DNA, 20 bp, Artificial Sequence
  sgRNA
  Slc34a2_3
agaggtgcagttatcagtcg

SEQ ID NO: 55705 - DNA, 20 bp, Artificial Sequence
  sgRNA
  Slc34a2_4
ctcaccgatgagtggagtca

SEQ ID NO: 55706 - DNA, 20 bp, Artificial Sequence
  sgRNA
  Slc34a2_5
accccggtaaattcatcgag

SEQ ID NO: 55707 - DNA, 20 bp, Artificial Sequence
  sgRNA
  Slc34a2_6
aggtgcagttatcagtcgag

SEQ ID NO: 55708 - DNA, 20 bp, Artificial Sequence
  sgRNA
  Slc34a2_7
gctgccatccccatcatcat

SEQ ID NO: 55709 - DNA, 20 bp, Artificial Sequence
  sgRNA
  Slc34a2_8
ttcagagagtgcatccacaa

SEQ ID NO: 55710 - DNA, 20 bp, Artificial Sequence
  sgRNA
  Slc34a2_9
tctgccatgactccactcat

SEQ ID NO: 55711 - DNA, 20 bp, Artificial Sequence
  sgRNA
  Slc34a2_10
ctacctggccatccttgtgg

SEQ ID NO: 55712 - DNA, 20 bp, Artificial Sequence
  sgRNA
  Slc34a2_11
gctaccctcctattccgccc

SEQ ID NO: 55713 - DNA, 20 bp, Artificial Sequence
  sgRNA
  Slc34a2_12
ggtcatccaacaaatcgcaa

SEQ ID NO: 55714 - DNA, 20 bp, Artificial Sequence
  sgRNA
  Slc34a2_13
aaccccggtaaattcatcga

SEQ ID NO: 55715 - DNA, 20 bp, Artificial Sequence
  sgRNA
  Slc34a2_14
tcgctgcagcaagtgctgca

SEQ ID NO: 55716 - DNA, 20 bp, Artificial Sequence
  sgRNA
  Slc34a2_15
tctcatagaggagcatcccg

SEQ ID NO: 55717 - DNA, 20 bp, Artificial Sequence
  sgRNA
  Slc34a2_16
gagggcatatccactcacgt

SEQ ID NO: 55718 - DNA, 20 bp, Artificial Sequence
  sgRNA
  Slc34a2_17
ctcatagaggagcatcccga

SEQ ID NO: 55719 - DNA, 20 bp, Artificial Sequence
  sgRNA
  Slc34a2_18
gcagttatcagtcgagggga

SEQ ID NO: 55720 - DNA, 20 bp, Artificial Sequence
  sgRNA
  Slc34a2_19
gttgttgctgaagaactgtc

SEQ ID NO: 55721 - DNA, 20 bp, Artificial Sequence
  sgRNA
  Slc34a2_20
tgcctaggcctttagccaga

SEQ ID NO: 55722 - DNA, 20 bp, Artificial Sequence
  sgRNA
  Slc34a3_1
aggttaggcctgcgccaacg

SEQ ID NO: 55723 - DNA, 20 bp, Artificial Sequence
  sgRNA
  Slc34a3_2
agttgagcagtttaacgatg

SEQ ID NO: 55724 - DNA, 20 bp, Artificial Sequence
  sgRNA
  Slc34a3_3
gatagcagtgtgataaccag

SEQ ID NO: 55725 - DNA, 20 bp, Artificial Sequence
  sgRNA
  Slc34a3_4
caatgaccaagcccgccaca

SEQ ID NO: 55726 - DNA, 20 bp, Artificial Sequence
  sgRNA
  Slc34a3_5
gctgcggtggcactctccag

SEQ ID NO: 55727 - DNA, 20 bp, Artificial Sequence
  sgRNA
  Slc34a3_6
gcagccatcgtgcctctcat

SEQ ID NO: 55728 - DNA, 20 bp, Artificial Sequence
  sgRNA
  Slc34a3_7
acagcagcctgattaagcat

SEQ ID NO: 55729 - DNA, 20 bp, Artificial Sequence
  sgRNA
  Slc34a3_8
gttgttgcaggacattaacc

SEQ ID NO: 55730 - DNA, 20 bp, Artificial Sequence
  sgRNA
  Slc34a3_9
cgaagattaacatgtctgca

SEQ ID NO: 55731 - DNA, 20 bp, Artificial Sequence
  sgRNA
  Slc34a3_10
acattgacgcccatgatgat

SEQ ID NO: 55732 - DNA, 20 bp, Artificial Sequence
  sgRNA
  Slc34a3_11
agttggtcagcgttcttcag

SEQ ID NO: 55733 - DNA, 20 bp, Artificial Sequence
  sgRNA
  Slc34a3_12
gcattggtgtggcttcaggg

SEQ ID NO: 55734 - DNA, 20 bp, Artificial Sequence
  sgRNA
  Slc34a3_13
gaaagtccaaaggctgctag

SEQ ID NO: 55735 - DNA, 20 bp, Artificial Sequence
  sgRNA
  Slc34a3_14
catccctcactgcttccctg

SEQ ID NO: 55736 - DNA, 20 bp, Artificial Sequence
  sgRNA
  Slc34a3_15
gactgcccagtatcgctggg

SEQ ID NO: 55737 - DNA, 20 bp, Artificial Sequence
  sgRNA
  Slc34a3_16
gcagtctcaagacaggcacc

SEQ ID NO: 55738 - DNA, 20 bp, Artificial Sequence
  sgRNA
  Slc34a3_17
gtagccgctgagccagccaa

SEQ ID NO: 55739 - DNA, 20 bp, Artificial Sequence
  sgRNA
  Slc34a3_18
tgttggaacccaagaagagg

SEQ ID NO: 55740 - DNA, 20 bp, Artificial Sequence
  sgRNA
  Slc34a3_19
ggtgttgctggtaataccgc

SEQ ID NO: 55741 - DNA, 20 bp, Artificial Sequence
  sgRNA
  Slc34a3_20
gttgaagggccgcatcgcac

SEQ ID NO: 55742 - DNA, 20 bp, Artificial Sequence
  sgRNA
  Slc35a5_1
attgaactataatcagaacg

SEQ ID NO: 55743 - DNA, 20 bp, Artificial Sequence
  sgRNA
  Slc35a5_2
aagagacaattgtacatcga

SEQ ID NO: 55744 - DNA, 20 bp, Artificial Sequence
  sgRNA
  Slc35a5_3
gattctgttcttgtctatcg

SEQ ID NO: 55745 - DNA, 20 bp, Artificial Sequence
  sgRNA
  Slc35a5_4
ctctgagcacacgttcacag

SEQ ID NO: 55746 - DNA, 20 bp, Artificial Sequence
  sgRNA
  Slc35a5_5
gcgttggtgggcctaaccca

SEQ ID NO: 55747 - DNA, 20 bp, Artificial Sequence
  sgRNA
  Slc35a5_6
gcatctgaactggatccagt

SEQ ID NO: 55748 - DNA, 20 bp, Artificial Sequence
  sgRNA
  Slc35a5_7
gttactgctctgaaggacca

SEQ ID NO: 55749 - DNA, 20 bp, Artificial Sequence
  sgRNA
  Slc35a5_8
ggcttctaggaaaaaatcca

SEQ ID NO: 55750 - DNA, 20 bp, Artificial Sequence
  sgRNA
  Slc35a5_9
actttcatgagcagccccgt

SEQ ID NO: 55751 - DNA, 20 bp, Artificial Sequence
  sgRNA
  Slc35a5_10
gaacgtggcccaagcccaaa

SEQ ID NO: 55752 - DNA, 20 bp, Artificial Sequence
  sgRNA
  Slc35a5_11
ttaaggcaattaaaaacccg

SEQ ID NO: 55753 - DNA, 20 bp, Artificial Sequence
  sgRNA
  Slc35a5_12
ctataatgagaagatcctga

SEQ ID NO: 55754 - DNA, 20 bp, Artificial Sequence
  sgRNA
  Slc35a5_13
gaaagaatccgccatctgag

SEQ ID NO: 55755 - DNA, 20 bp, Artificial Sequence
  sgRNA
  Slc35a5_14
gagcacacgttcacagtggt

SEQ ID NO: 55756 - DNA, 20 bp, Artificial Sequence
  sgRNA
  Slc35a5_15
agcacacgttcacagtggta

SEQ ID NO: 55757 - DNA, 20 bp, Artificial Sequence
  sgRNA
  Slc35a5_16
cctgaagtcaaagaccagga

SEQ ID NO: 55758 - DNA, 20 bp, Artificial Sequence
  sgRNA
  Slc35a5_17
aaagactgccactcagatgg

SEQ ID NO: 55759 - DNA, 20 bp, Artificial Sequence
  sgRNA
  Slc35a5_18
agtcacatccgtttgggctt

SEQ ID NO: 55760 - DNA, 20 bp, Artificial Sequence
  sgRNA
  Slc35a5_19
cacagttctgaatctggtca

SEQ ID NO: 55761 - DNA, 20 bp, Artificial Sequence
  sgRNA
  Slc35a5_20
agcaggaatgtgtacagcgt

SEQ ID NO: 55762 - DNA, 20 bp, Artificial Sequence
  sgRNA
  Slc35f4_1
gatggccggaataatagact

SEQ ID NO: 55763 - DNA, 20 bp, Artificial Sequence
  sgRNA
  Slc35f4_2
tcagttactcgatgcaaacc

SEQ ID NO: 55764 - DNA, 20 bp, Artificial Sequence
  sgRNA
  Slc35f4_3
cattgtcatgatggcgtatg

SEQ ID NO: 55765 - DNA, 20 bp, Artificial Sequence
  sgRNA
  Slc35f4_4
atggttctgaagaccatctg

SEQ ID NO: 55766 - DNA, 20 bp, Artificial Sequence
  sgRNA
  Slc35f4_5
aatcttccgtgaccgacaga

SEQ ID NO: 55767 - DNA, 20 bp, Artificial Sequence
  sgRNA
  Slc35f4_6
caccgatgatggaatcagcg

SEQ ID NO: 55768 - DNA, 20 bp, Artificial Sequence
  sgRNA
  Slc35f4_7
ggcacacttaattccatgcg

SEQ ID NO: 55769 - DNA, 20 bp, Artificial Sequence
  sgRNA
  Slc35f4_8
gtaccactccaacattgacc

SEQ ID NO: 55770 - DNA, 20 bp, Artificial Sequence
  sgRNA
  Slc35f4_9
tcttcgaccacaaactccag

SEQ ID NO: 55771 - DNA, 20 bp, Artificial Sequence
  sgRNA
  Slc35f4_10
gtttctcctgatgctactgc

SEQ ID NO: 55772 - DNA, 20 bp, Artificial Sequence
  sgRNA
  Slc35f4_11
catagtagccagtaatccgc

SEQ ID NO: 55773 - DNA, 20 bp, Artificial Sequence
  sgRNA
  Slc35f4_12
atcccacagaggcagcccca

SEQ ID NO: 55774 - DNA, 20 bp, Artificial Sequence
  sgRNA
  Slc35f4_13
tggctactatggctattacc

SEQ ID NO: 55775 - DNA, 20 bp, Artificial Sequence
  sgRNA
  Slc35f4_14
tggagtttgtggtcgaagag

SEQ ID NO: 55776 - DNA, 20 bp, Artificial Sequence
  sgRNA
  Slc35f4_15
ggtgcacgctgacatctgtc

SEQ ID NO: 55777 - DNA, 20 bp, Artificial Sequence
  sgRNA
  Slc35f4_16
gatcaaattgaagaacccca

SEQ ID NO: 55778 - DNA, 20 bp, Artificial Sequence
  sgRNA
  Slc35f4_17
agatggccggaataatagac

SEQ ID NO: 55779 - DNA, 20 bp, Artificial Sequence
  sgRNA
  Slc35f4_18
gcacctgaggagcagaagca

SEQ ID NO: 55780 - DNA, 20 bp, Artificial Sequence
  sgRNA
  Slc35f4_19
attcttgaacttcagagccg

SEQ ID NO: 55781 - DNA, 20 bp, Artificial Sequence
  sgRNA
  Slc35f4_20
ggctactatggctattaccc

SEQ ID NO: 55782 - DNA, 20 bp, Artificial Sequence
  sgRNA
  Slc36a1_1
agaagatggacaacacacgc

SEQ ID NO: 55783 - DNA, 20 bp, Artificial Sequence
  sgRNA
  Slc36a1_2
gtccggaaccactcccactg

SEQ ID NO: 55784 - DNA, 20 bp, Artificial Sequence
  sgRNA
  Slc36a1_3
ctgtactctacatcagcctg

SEQ ID NO: 55785 - DNA, 20 bp, Artificial Sequence
  sgRNA
  Slc36a1_4
atcgctgtgccaaagaacag

SEQ ID NO: 55786 - DNA, 20 bp, Artificial Sequence
  sgRNA
  Slc36a1_5
cctgcgttcttcactgccag

SEQ ID NO: 55787 - DNA, 20 bp, Artificial Sequence
  sgRNA
  Slc36a1_6
tactgttctctcctaagcgt

SEQ ID NO: 55788 - DNA, 20 bp, Artificial Sequence
  sgRNA
  Slc36a1_7
tcgctgtgccaaagaacaga

SEQ ID NO: 55789 - DNA, 20 bp, Artificial Sequence
  sgRNA
  Slc36a1_8
tgtgccaaagaacagagggt

SEQ ID NO: 55790 - DNA, 20 bp, Artificial Sequence
  sgRNA
  Slc36a1_9
gttctctcctaagcgttggt

SEQ ID NO: 55791 - DNA, 20 bp, Artificial Sequence
  sgRNA
  Slc36a1_10
ccacgataccaatcaccagc

SEQ ID NO: 55792 - DNA, 20 bp, Artificial Sequence
  sgRNA
  Slc36a1_11
gtgtccccatagtccaaaaa

SEQ ID NO: 55793 - DNA, 20 bp, Artificial Sequence
  sgRNA
  Slc36a1_12
gtgaagctgctgtactccat

SEQ ID NO: 55794 - DNA, 20 bp, Artificial Sequence
  sgRNA
  Slc36a1_13
agtacagcagcttcaccgac

SEQ ID NO: 55795 - DNA, 20 bp, Artificial Sequence
  sgRNA
  Slc36a1_14
gtagaggagtcgctatggct

SEQ ID NO: 55796 - DNA, 20 bp, Artificial Sequence
  sgRNA
  Slc36a1_15
tcttccatggagccaccaag

SEQ ID NO: 55797 - DNA, 20 bp, Artificial Sequence
  sgRNA
  Slc36a1_16
ctaagcgttggtaggagccg

SEQ ID NO: 55798 - DNA, 20 bp, Artificial Sequence
  sgRNA
  Slc36a1_17
agctgccaaggccttcagat

SEQ ID NO: 55799 - DNA, 20 bp, Artificial Sequence
  sgRNA
  Slc36a1_18
acatgtcacacagaccatgg

SEQ ID NO: 55800 - DNA, 20 bp, Artificial Sequence
  sgRNA
  Slc36a1_19
tgatgaaagacagcaacacc

SEQ ID NO: 55801 - DNA, 20 bp, Artificial Sequence
  sgRNA
  Slc36a1_20
actgtactctacatcagcct

SEQ ID NO: 55802 - DNA, 20 bp, Artificial Sequence
  sgRNA
  Slc36a2_1
tgactaggatgtgcatacag

SEQ ID NO: 55803 - DNA, 20 bp, Artificial Sequence
  sgRNA
  Slc36a2_2
ggtagttctgacgcccacca

SEQ ID NO: 55804 - DNA, 20 bp, Artificial Sequence
  sgRNA
  Slc36a2_3
agcaaagtacctcccccagt

SEQ ID NO: 55805 - DNA, 20 bp, Artificial Sequence
  sgRNA
  Slc36a2_4
agccccgatagcaatgtaca

SEQ ID NO: 55806 - DNA, 20 bp, Artificial Sequence
  sgRNA
  Slc36a2_5
gagtcatcaaagaagaccaa

SEQ ID NO: 55807 - DNA, 20 bp, Artificial Sequence
  sgRNA
  Slc36a2_6
tgatgtcatctccaaaccgc

SEQ ID NO: 55808 - DNA, 20 bp, Artificial Sequence
  sgRNA
  Slc36a2_7
ggacttgatcagctcatcca

SEQ ID NO: 55809 - DNA, 20 bp, Artificial Sequence
  sgRNA
  Slc36a2_8
gggggatgatgatttccgca

SEQ ID NO: 55810 - DNA, 20 bp, Artificial Sequence
  sgRNA
  Slc36a2_9
cctgcagttctacgtccctg

SEQ ID NO: 55811 - DNA, 20 bp, Artificial Sequence
  sgRNA
  Slc36a2_10
gtgtccccatagtccatgaa

SEQ ID NO: 55812 - DNA, 20 bp, Artificial Sequence
  sgRNA
  Slc36a2_11
aacaagatgaaggatgcccg

SEQ ID NO: 55813 - DNA, 20 bp, Artificial Sequence
  sgRNA
  Slc36a2_12
cgcagggacgtagaactgca

SEQ ID NO: 55814 - DNA, 20 bp, Artificial Sequence
  sgRNA
  Slc36a2_13
gcatacagtggcaggcgatg

SEQ ID NO: 55815 - DNA, 20 bp, Artificial Sequence
  sgRNA
  Slc36a2_14
tctggcggacaatttaaaac

SEQ ID NO: 55816 - DNA, 20 bp, Artificial Sequence
  sgRNA
  Slc36a2_15
tatggggacacagtgatgca

SEQ ID NO: 55817 - DNA, 20 bp, Artificial Sequence
  sgRNA
  Slc36a2_16
tcacagccaggggaagtccg

SEQ ID NO: 55818 - DNA, 20 bp, Artificial Sequence
  sgRNA
  Slc36a2_17
gagccccgatagcaatgtac

SEQ ID NO: 55819 - DNA, 20 bp, Artificial Sequence
  sgRNA
  Slc36a2_18
agatgccagccagttgccac

SEQ ID NO: 55820 - DNA, 20 bp, Artificial Sequence
  sgRNA
  Slc36a2_19
gctgcaaaaccacgcccact

SEQ ID NO: 55821 - DNA, 20 bp, Artificial Sequence
  sgRNA
  Slc36a2_20
ctctcaggtgtcaaaacgct

SEQ ID NO: 55822 - DNA, 20 bp, Artificial Sequence
  sgRNA
  Slc36a3_1
tccccagatacagcacagcg

SEQ ID NO: 55823 - DNA, 20 bp, Artificial Sequence
  sgRNA
  Slc36a3_2
agagaccacaatgtacagcc

SEQ ID NO: 55824 - DNA, 20 bp, Artificial Sequence
  sgRNA
  Slc36a3_3
tgagcgccccgatggccaag

SEQ ID NO: 55825 - DNA, 20 bp, Artificial Sequence
  sgRNA
  Slc36a3_4
cacctgttgaaaagcaacat

SEQ ID NO: 55826 - DNA, 20 bp, Artificial Sequence
  sgRNA
  Slc36a3_5
gtagtggcaccccttccagc

SEQ ID NO: 55827 - DNA, 20 bp, Artificial Sequence
  sgRNA
  Slc36a3_6
gtgcactgtgagcgccccga

SEQ ID NO: 55828 - DNA, 20 bp, Artificial Sequence
  sgRNA
  Slc36a3_7
aatgtggcaatctccagcag

SEQ ID NO: 55829 - DNA, 20 bp, Artificial Sequence
  sgRNA
  Slc36a3_8
tcttcacctttgaaggcgtg

SEQ ID NO: 55830 - DNA, 20 bp, Artificial Sequence
  sgRNA
  Slc36a3_9
cctccaacgtctgccagccg

SEQ ID NO: 55831 - DNA, 20 bp, Artificial Sequence
  sgRNA
  Slc36a3_10
agcagtacctccccaaagaa

SEQ ID NO: 55832 - DNA, 20 bp, Artificial Sequence
  sgRNA
  Slc36a3_11
gagtccccaggcagatgtag

SEQ ID NO: 55833 - DNA, 20 bp, Artificial Sequence
  sgRNA
  Slc36a3_12
gtcagcggaatatgttcggt

SEQ ID NO: 55834 - DNA, 20 bp, Artificial Sequence
  sgRNA
  Slc36a3_13
gatcatgatgtccttgacaa

SEQ ID NO: 55835 - DNA, 20 bp, Artificial Sequence
  sgRNA
  Slc36a3_14
catccccagatacagcacag

SEQ ID NO: 55836 - DNA, 20 bp, Artificial Sequence
  sgRNA
  Slc36a3_15
ggtgctcatccagaacccac

SEQ ID NO: 55837 - DNA, 20 bp, Artificial Sequence
  sgRNA
  Slc36a3_16
gggagatgaccaggtccagg

SEQ ID NO: 55838 - DNA, 20 bp, Artificial Sequence
  sgRNA
  Slc36a3_17
gtacacaccctaagaggccc

SEQ ID NO: 55839 - DNA, 20 bp, Artificial Sequence
  sgRNA
  Slc36a3_18
acactcttgagacgacatag

SEQ ID NO: 55840 - DNA, 20 bp, Artificial Sequence
  sgRNA
  Slc36a3_19
ttacatggccaactctacaa

SEQ ID NO: 55841 - DNA, 20 bp, Artificial Sequence
  sgRNA
  Slc36a3_20
gcgcatcagcttccctgcga

SEQ ID NO: 55842 - DNA, 20 bp, Artificial Sequence
  sgRNA
  Slc36a4_1
tttcgatgggtcgtccgacg

SEQ ID NO: 55843 - DNA, 20 bp, Artificial Sequence
  sgRNA
  Slc36a4_2
tcaggcattgaacatcggca

SEQ ID NO: 55844 - DNA, 20 bp, Artificial Sequence
  sgRNA
  Slc36a4_3
ccgcgttctttatagccaag

SEQ ID NO: 55845 - DNA, 20 bp, Artificial Sequence
  sgRNA
  Slc36a4_4
ttgccatggaggctagtccg

SEQ ID NO: 55846 - DNA, 20 bp, Artificial Sequence
  sgRNA
  Slc36a4_5
tgccgatgttcaatgcctga

SEQ ID NO: 55847 - DNA, 20 bp, Artificial Sequence
  sgRNA
  Slc36a4_6
tgtcgctgaaggcaactcca

SEQ ID NO: 55848 - DNA, 20 bp, Artificial Sequence
  sgRNA
  Slc36a4_7
ggctaggctgatgtacagca

SEQ ID NO: 55849 - DNA, 20 bp, Artificial Sequence
  sgRNA
  Slc36a4_8
cattgtgatctccttcgtgg

SEQ ID NO: 55850 - DNA, 20 bp, Artificial Sequence
  sgRNA
  Slc36a4_9
tgtttccgtgacgagatcaa

SEQ ID NO: 55851 - DNA, 20 bp, Artificial Sequence
  sgRNA
  Slc36a4_10
gtaaggatttccacaagtgg

SEQ ID NO: 55852 - DNA, 20 bp, Artificial Sequence
  sgRNA
  Slc36a4_11
atagcgttcactggagtcgt

SEQ ID NO: 55853 - DNA, 20 bp, Artificial Sequence
  sgRNA
  Slc36a4_12
taaacgagcagaatttcgat

SEQ ID NO: 55854 - DNA, 20 bp, Artificial Sequence
  sgRNA
  Slc36a4_13
cagtgggtatttcttccagc

SEQ ID NO: 55855 - DNA, 20 bp, Artificial Sequence
  sgRNA
  Slc36a4_14
gcagtcactttctatgtcag

SEQ ID NO: 55856 - DNA, 20 bp, Artificial Sequence
  sgRNA
  Slc36a4_15
cgtctgttcctgctcctcgt

SEQ ID NO: 55857 - DNA, 20 bp, Artificial Sequence
  sgRNA
  Slc36a4_16
cagcagtgccaaaaaacagt

SEQ ID NO: 55858 - DNA, 20 bp, Artificial Sequence
  sgRNA
  Slc36a4_17
gagatcacaatgtctaggcg

SEQ ID NO: 55859 - DNA, 20 bp, Artificial Sequence
  sgRNA
  Slc36a4_18
gtaccaatatgtgcatacag

SEQ ID NO: 55860 - DNA, 20 bp, Artificial Sequence
  sgRNA
  Slc36a4_19
gctgctcacagcccccacga

SEQ ID NO: 55861 - DNA, 20 bp, Artificial Sequence
  sgRNA
  Slc36a4_20
cccgcgttctttatagccaa

SEQ ID NO: 55862 - DNA, 20 bp, Artificial Sequence
  sgRNA
  Slc37a1_1
ctgaacaatgagaccgactg

SEQ ID NO: 55863 - DNA, 20 bp, Artificial Sequence
  sgRNA
  Slc37a1_2
gttcccctattattccactg

SEQ ID NO: 55864 - DNA, 20 bp, Artificial Sequence
  sgRNA
  Slc37a1_3
ccacagcctgggattctacg

SEQ ID NO: 55865 - DNA, 20 bp, Artificial Sequence
  sgRNA
  Slc37a1_4
atcatgctgtgttgtaggcg

SEQ ID NO: 55866 - DNA, 20 bp, Artificial Sequence
  sgRNA
  Slc37a1_5
tggaggctcgtttctccaga

SEQ ID NO: 55867 - DNA, 20 bp, Artificial Sequence
  sgRNA
  Slc37a1_6
aacacgttgctccatccaga

SEQ ID NO: 55868 - DNA, 20 bp, Artificial Sequence
  sgRNA
  Slc37a1_7
gcagtggtgatcagtgcgta

SEQ ID NO: 55869 - DNA, 20 bp, Artificial Sequence
  sgRNA
  Slc37a1_8
cggccatgttgccatcagca

SEQ ID NO: 55870 - DNA, 20 bp, Artificial Sequence
  sgRNA
  Slc37a1_9
aatggactggtgcagaccac

SEQ ID NO: 55871 - DNA, 20 bp, Artificial Sequence
  sgRNA
  Slc37a1_10
gctgtccacattgtttgacg

SEQ ID NO: 55872 - DNA, 20 bp, Artificial Sequence
  sgRNA
  Slc37a1_11
gtgaagggggttcttcccgt

SEQ ID NO: 55873 - DNA, 20 bp, Artificial Sequence
  sgRNA
  Slc37a1_12
tgataggctttcgggataag

SEQ ID NO: 55874 - DNA, 20 bp, Artificial Sequence
  sgRNA
  Slc37a1_13
ggctcgtttctccagacggt

SEQ ID NO: 55875 - DNA, 20 bp, Artificial Sequence
  sgRNA
  Slc37a1_14
ggactcacaagagtctgaaa

SEQ ID NO: 55876 - DNA, 20 bp, Artificial Sequence
  sgRNA
  Slc37a1_15
accgtgacagccatcatcga

SEQ ID NO: 55877 - DNA, 20 bp, Artificial Sequence
  sgRNA
  Slc37a1_16
tcaggtaatacctaatcggc

SEQ ID NO: 55878 - DNA, 20 bp, Artificial Sequence
  sgRNA
  Slc37a1_17
tctccttctccagggatcag

SEQ ID NO: 55879 - DNA, 20 bp, Artificial Sequence
  sgRNA
  Slc37a1_18
cagtgcttgctactctccga

SEQ ID NO: 55880 - DNA, 20 bp, Artificial Sequence
  sgRNA
  Slc37a1_19
ggaggacaacaatatggctt

SEQ ID NO: 55881 - DNA, 20 bp, Artificial Sequence
  sgRNA
  Slc37a1_20
agtgcttgctactctccgac

SEQ ID NO: 55882 - DNA, 20 bp, Artificial Sequence
  sgRNA
  Slc37a2_1
ttagcaccattccagccgag

SEQ ID NO: 55883 - DNA, 20 bp, Artificial Sequence
  sgRNA
  Slc37a2_2
acgatctcaatgataccacc

SEQ ID NO: 55884 - DNA, 20 bp, Artificial Sequence
  sgRNA
  Slc37a2_3
cccacattgaagatgtacaa

SEQ ID NO: 55885 - DNA, 20 bp, Artificial Sequence
  sgRNA
  Slc37a2_4
ggcttgtgcagactacaggc

SEQ ID NO: 55886 - DNA, 20 bp, Artificial Sequence
  sgRNA
  Slc37a2_5
actgtcacggccattatcga

SEQ ID NO: 55887 - DNA, 20 bp, Artificial Sequence
  sgRNA
  Slc37a2_6
ggtggtatcattgagatcgt

SEQ ID NO: 55888 - DNA, 20 bp, Artificial Sequence
  sgRNA
  Slc37a2_7
gccgagaggtagtaacgcag

SEQ ID NO: 55889 - DNA, 20 bp, Artificial Sequence
  sgRNA
  Slc37a2_8
gttccttcgcgccttctcta

SEQ ID NO: 55890 - DNA, 20 bp, Artificial Sequence
  sgRNA
  Slc37a2_9
gcccctgcgttactacctct

SEQ ID NO: 55891 - DNA, 20 bp, Artificial Sequence
  sgRNA
  Slc37a2_10
tgtggacaatgccttcctag

SEQ ID NO: 55892 - DNA, 20 bp, Artificial Sequence
  sgRNA
  Slc37a2_11
ggatattccagaagtacccc

SEQ ID NO: 55893 - DNA, 20 bp, Artificial Sequence
  sgRNA
  Slc37a2_12
gccgggctcatttccccgac

SEQ ID NO: 55894 - DNA, 20 bp, Artificial Sequence
  sgRNA
  Slc37a2_13
agccgagaggtagtaacgca

SEQ ID NO: 55895 - DNA, 20 bp, Artificial Sequence
  sgRNA
  Slc37a2_14
tgagcagcaggatgaagcca

SEQ ID NO: 55896 - DNA, 20 bp, Artificial Sequence
  sgRNA
  Slc37a2_15
tctggaatatccacatgctc

SEQ ID NO: 55897 - DNA, 20 bp, Artificial Sequence
  sgRNA
  Slc37a2_16
ttacgcactcatcacgacag

SEQ ID NO: 55898 - DNA, 20 bp, Artificial Sequence
  sgRNA
  Slc37a2_17
gaatagtccctacagcagca

SEQ ID NO: 55899 - DNA, 20 bp, Artificial Sequence
  sgRNA
  Slc37a2_18
gatcagcatgatgcagcaag

SEQ ID NO: 55900 - DNA, 20 bp, Artificial Sequence
  sgRNA
  Slc37a2_19
gcaccagaactgctcagaga

SEQ ID NO: 55901 - DNA, 20 bp, Artificial Sequence
  sgRNA
  Slc37a2_20
gtctgggtgaaccagcactg

SEQ ID NO: 55902 - DNA, 20 bp, Artificial Sequence
  sgRNA
  Slc37a4_1
ctacgttgaccagaccaacc

SEQ ID NO: 55903 - DNA, 20 bp, Artificial Sequence
  sgRNA
  Slc37a4_2
tctttactccgaagaccacg

SEQ ID NO: 55904 - DNA, 20 bp, Artificial Sequence
  sgRNA
  Slc37a4_3
cacaaacttgctgatggcgt

SEQ ID NO: 55905 - DNA, 20 bp, Artificial Sequence
  sgRNA
  Slc37a4_4
cagagcgatctcatccacca

SEQ ID NO: 55906 - DNA, 20 bp, Artificial Sequence
  sgRNA
  Slc37a4_5
tcttccttatccaggagcga

SEQ ID NO: 55907 - DNA, 20 bp, Artificial Sequence
  sgRNA
  Slc37a4_6
gtagcaataggccgtgacga

SEQ ID NO: 55908 - DNA, 20 bp, Artificial Sequence
  sgRNA
  Slc37a4_7
gcgatctcatccaccaagga

SEQ ID NO: 55909 - DNA, 20 bp, Artificial Sequence
  sgRNA
  Slc37a4_8
atactcggcccatcttggtg

SEQ ID NO: 55910 - DNA, 20 bp, Artificial Sequence
  sgRNA
  Slc37a4_9
gcgatagtagccgtagcctt

SEQ ID NO: 55911 - DNA, 20 bp, Artificial Sequence
  sgRNA
  Slc37a4_10
tttcggagtccaacatcagc

SEQ ID NO: 55912 - DNA, 20 bp, Artificial Sequence
  sgRNA
  Slc37a4_11
ggacagcacccagagatagg

SEQ ID NO: 55913 - DNA, 20 bp, Artificial Sequence
  sgRNA
  Slc37a4_12
gctcatcacaagcagccagt

SEQ ID NO: 55914 - DNA, 20 bp, Artificial Sequence
  sgRNA
  Slc37a4_13
tgcttggcaatggtgctgaa

SEQ ID NO: 55915 - DNA, 20 bp, Artificial Sequence
  sgRNA
  Slc37a4_14
tgatggcgtaggctgccgac

SEQ ID NO: 55916 - DNA, 20 bp, Artificial Sequence
  sgRNA
  Slc37a4_15
catgttcctcttccgagtaa

SEQ ID NO: 55917 - DNA, 20 bp, Artificial Sequence
  sgRNA
  Slc37a4_16
gtgatgagccctgcagcgaa

SEQ ID NO: 55918 - DNA, 20 bp, Artificial Sequence
  sgRNA
  Slc37a4_17
cgaaatatccgcaccaagat

SEQ ID NO: 55919 - DNA, 20 bp, Artificial Sequence
  sgRNA
  Slc37a4_18
agctggttacctgtcagaca

SEQ ID NO: 55920 - DNA, 20 bp, Artificial Sequence
  sgRNA
  Slc37a4_19
atgggccgagtatccaagaa

SEQ ID NO: 55921 - DNA, 20 bp, Artificial Sequence
  sgRNA
  Slc37a4_20
agtagcaataggccgtgacg

SEQ ID NO: 55922 - DNA, 20 bp, Artificial Sequence
  sgRNA
  Slc38a1_1
atactttggtgtgcacgcgt

SEQ ID NO: 55923 - DNA, 20 bp, Artificial Sequence
  sgRNA
  Slc38a1_2
tgcatggtgtatgagaagct

SEQ ID NO: 55924 - DNA, 20 bp, Artificial Sequence
  sgRNA
  Slc38a1_3
tcaccatcaccaccaacact

SEQ ID NO: 55925 - DNA, 20 bp, Artificial Sequence
  sgRNA
  Slc38a1_4
agattggcaggacggacggg

SEQ ID NO: 55926 - DNA, 20 bp, Artificial Sequence
  sgRNA
  Slc38a1_5
gaagatcaccagcttccccg

SEQ ID NO: 55927 - DNA, 20 bp, Artificial Sequence
  sgRNA
  Slc38a1_6
cacgatgacggccagccgca

SEQ ID NO: 55928 - DNA, 20 bp, Artificial Sequence
  sgRNA
  Slc38a1_7
tcttcaagagacacagcgga

SEQ ID NO: 55929 - DNA, 20 bp, Artificial Sequence
  sgRNA
  Slc38a1_8
acattctcatcctaaccgtg

SEQ ID NO: 55930 - DNA, 20 bp, Artificial Sequence
  sgRNA
  Slc38a1_9
cctactgctgatctgttcca

SEQ ID NO: 55931 - DNA, 20 bp, Artificial Sequence
  sgRNA
  Slc38a1_10
gcccagtcgtagatgaccag

SEQ ID NO: 55932 - DNA, 20 bp, Artificial Sequence
  sgRNA
  Slc38a1_11
ccaaagatatccttcatgga

SEQ ID NO: 55933 - DNA, 20 bp, Artificial Sequence
  sgRNA
  Slc38a1_12
ctcgctgtagattggcagga

SEQ ID NO: 55934 - DNA, 20 bp, Artificial Sequence
  sgRNA
  Slc38a1_13
tctcagatcgggagagtagg

SEQ ID NO: 55935 - DNA, 20 bp, Artificial Sequence
  sgRNA
  Slc38a1_14
cccagtcgtagatgaccaga

SEQ ID NO: 55936 - DNA, 20 bp, Artificial Sequence
  sgRNA
  Slc38a1_15
ttctgctccacactcatgca

SEQ ID NO: 55937 - DNA, 20 bp, Artificial Sequence
  sgRNA
  Slc38a1_16
agagcaagtcttcggcacca

SEQ ID NO: 55938 - DNA, 20 bp, Artificial Sequence
  sgRNA
  Slc38a1_17
ggttaaagacagacattccc

SEQ ID NO: 55939 - DNA, 20 bp, Artificial Sequence
  sgRNA
  Slc38a1_18
ctgtgtctcttgaagaacct

SEQ ID NO: 55940 - DNA, 20 bp, Artificial Sequence
  sgRNA
  Slc38a1_19
gcagacaaacgcgaaggcga

SEQ ID NO: 55941 - DNA, 20 bp, Artificial Sequence
  sgRNA
  Slc38a1_20
gttaaagacagacattccca

SEQ ID NO: 55942 - DNA, 20 bp, Artificial Sequence
  sgRNA
  Slc38a11_1
atctccggacatgaacacgg

SEQ ID NO: 55943 - DNA, 20 bp, Artificial Sequence
  sgRNA
  Slc38a11_2
ttcttggaatcgtaatgaca

SEQ ID NO: 55944 - DNA, 20 bp, Artificial Sequence
  sgRNA
  Slc38a11_3
ttatggtggcaaatgaacgc

SEQ ID NO: 55945 - DNA, 20 bp, Artificial Sequence
  sgRNA
  Slc38a11_4
aataaaagcagtattcccaa

SEQ ID NO: 55946 - DNA, 20 bp, Artificial Sequence
  sgRNA
  Slc38a11_5
tctccggacatgaacacgga

SEQ ID NO: 55947 - DNA, 20 bp, Artificial Sequence
  sgRNA
  Slc38a11_6
agtcccaccaaaaaacacat

SEQ ID NO: 55948 - DNA, 20 bp, Artificial Sequence
  sgRNA
  Slc38a11_7
gtagaacatttcctgcccgt

SEQ ID NO: 55949 - DNA, 20 bp, Artificial Sequence
  sgRNA
  Slc38a11_8
cagttgaagatgagaccagg

SEQ ID NO: 55950 - DNA, 20 bp, Artificial Sequence
  sgRNA
  Slc38a11_9
tgtgtgctctttgcaacgtg

SEQ ID NO: 55951 - DNA, 20 bp, Artificial Sequence
  sgRNA
  Slc38a11_10
tgtcatgtttcccgtcgggg

SEQ ID NO: 55952 - DNA, 20 bp, Artificial Sequence
  sgRNA
  Slc38a11_11
gcctgtgtcatgtttcccgt

SEQ ID NO: 55953 - DNA, 20 bp, Artificial Sequence
  sgRNA
  Slc38a11_12
gatggtggtaggcttcgtca

SEQ ID NO: 55954 - DNA, 20 bp, Artificial Sequence
  sgRNA
  Slc38a11_13
gactaataaaccaacctcca

SEQ ID NO: 55955 - DNA, 20 bp, Artificial Sequence
  sgRNA
  Slc38a11_14
aggtcttgttaaccaaagac

SEQ ID NO: 55956 - DNA, 20 bp, Artificial Sequence
  sgRNA
  Slc38a11_15
tgagttctaaaactattcca

SEQ ID NO: 55957 - DNA, 20 bp, Artificial Sequence
  sgRNA
  Slc38a11_16
ctggtcacaaagcattcaat

SEQ ID NO: 55958 - DNA, 20 bp, Artificial Sequence
  sgRNA
  Slc38a11_17
tatcagcagccacagctgag

SEQ ID NO: 55959 - DNA, 20 bp, Artificial Sequence
  sgRNA
  Slc38a11_18
agtagaacatttcctgcccg

SEQ ID NO: 55960 - DNA, 20 bp, Artificial Sequence
  sgRNA
  Slc38a11_19
ccacagtagcgaagtggcgc

SEQ ID NO: 55961 - DNA, 20 bp, Artificial Sequence
  sgRNA
  Slc38a11_20
gtgtgctctttgcaacgtgc

SEQ ID NO: 55962 - DNA, 20 bp, Artificial Sequence
  sgRNA
  Slc38a2_1
ccaccaaagcagcttccacg

SEQ ID NO: 55963 - DNA, 20 bp, Artificial Sequence
  sgRNA
  Slc38a2_2
ctcaagactgccaacgaagg

SEQ ID NO: 55964 - DNA, 20 bp, Artificial Sequence
  sgRNA
  Slc38a2_3
gcagtgacaatggaagaatg

SEQ ID NO: 55965 - DNA, 20 bp, Artificial Sequence
  sgRNA
  Slc38a2_4
gagttgaagatgaaatagcg

SEQ ID NO: 55966 - DNA, 20 bp, Artificial Sequence
  sgRNA
  Slc38a2_5
atacctactccgagatcgtg

SEQ ID NO: 55967 - DNA, 20 bp, Artificial Sequence
  sgRNA
  Slc38a2_6
tgatgtagaaggcagacggg

SEQ ID NO: 55968 - DNA, 20 bp, Artificial Sequence
  sgRNA
  Slc38a2_7
gtttcagatcccttgccccg

SEQ ID NO: 55969 - DNA, 20 bp, Artificial Sequence
  sgRNA
  Slc38a2_8
gtaagtgagtgacggaactc

SEQ ID NO: 55970 - DNA, 20 bp, Artificial Sequence
  sgRNA
  Slc38a2_9
aaataactactgggaccgtg

SEQ ID NO: 55971 - DNA, 20 bp, Artificial Sequence
  sgRNA
  Slc38a2_10
gcatacctactccgagatcg

SEQ ID NO: 55972 - DNA, 20 bp, Artificial Sequence
  sgRNA
  Slc38a2_11
tgaacattgaagatacaaat

SEQ ID NO: 55973 - DNA, 20 bp, Artificial Sequence
  sgRNA
  Slc38a2_12
cagccaccagcacagccaat

SEQ ID NO: 55974 - DNA, 20 bp, Artificial Sequence
  sgRNA
  Slc38a2_13
ttcgtagatgggaagaacag

SEQ ID NO: 55975 - DNA, 20 bp, Artificial Sequence
  sgRNA
  Slc38a2_14
ctactcataccccaccaagc

SEQ ID NO: 55976 - DNA, 20 bp, Artificial Sequence
  sgRNA
  Slc38a2_15
gggacacagtaagtgagtga

SEQ ID NO: 55977 - DNA, 20 bp, Artificial Sequence
  sgRNA
  Slc38a2_16
gtggccaacgaaactgtgaa

SEQ ID NO: 55978 - DNA, 20 bp, Artificial Sequence
  sgRNA
  Slc38a2_17
tcatcatccgtctccggctg

SEQ ID NO: 55979 - DNA, 20 bp, Artificial Sequence
  sgRNA
  Slc38a2_18
cgaagatgtccctaatagtg

SEQ ID NO: 55980 - DNA, 20 bp, Artificial Sequence
  sgRNA
  Slc38a2_19
acacgttcatcatccgtctc

SEQ ID NO: 55981 - DNA, 20 bp, Artificial Sequence
  sgRNA
  Slc38a2_20
ctgcatggttatcgatccgg

SEQ ID NO: 55982 - DNA, 20 bp, Artificial Sequence
  sgRNA
  Slc38a4_1
ccacggacacaaataagacg

SEQ ID NO: 55983 - DNA, 20 bp, Artificial Sequence
  sgRNA
  Slc38a4_2
gaagaagctagccgattacg

SEQ ID NO: 55984 - DNA, 20 bp, Artificial Sequence
  sgRNA
  Slc38a4_3
gatctcgctgcctaatgact

SEQ ID NO: 55985 - DNA, 20 bp, Artificial Sequence
  sgRNA
  Slc38a4_4
gatgaagaggtagcttgaca

SEQ ID NO: 55986 - DNA, 20 bp, Artificial Sequence
  sgRNA
  Slc38a4_5
gcagtgtgatcaccgaagta

SEQ ID NO: 55987 - DNA, 20 bp, Artificial Sequence
  sgRNA
  Slc38a4_6
aacgtcagcatcgaacccga

SEQ ID NO: 55988 - DNA, 20 bp, Artificial Sequence
  sgRNA
  Slc38a4_7
tgtatttgatggtaggcacg

SEQ ID NO: 55989 - DNA, 20 bp, Artificial Sequence
  sgRNA
  Slc38a4_8
ctcgggtgtgaacttcatga

SEQ ID NO: 55990 - DNA, 20 bp, Artificial Sequence
  sgRNA
  Slc38a4_9
ggcgtggagtacgaagccca

SEQ ID NO: 55991 - DNA, 20 bp, Artificial Sequence
  sgRNA
  Slc38a4_10
cctgctctggatcacaacaa

SEQ ID NO: 55992 - DNA, 20 bp, Artificial Sequence
  sgRNA
  Slc38a4_11
ggcaatactctcgctctact

SEQ ID NO: 55993 - DNA, 20 bp, Artificial Sequence
  sgRNA
  Slc38a4_12
gctgctgcatgcttacagca

SEQ ID NO: 55994 - DNA, 20 bp, Artificial Sequence
  sgRNA
  Slc38a4_13
cggtcagtgtcactgccacc

SEQ ID NO: 55995 - DNA, 20 bp, Artificial Sequence
  sgRNA
  Slc38a4_14
atcccgcagaaagatgcaga

SEQ ID NO: 55996 - DNA, 20 bp, Artificial Sequence
  sgRNA
  Slc38a4_15
ggcagcgagatcatgtgaat

SEQ ID NO: 55997 - DNA, 20 bp, Artificial Sequence
  sgRNA
  Slc38a4_16
ctaagatcaccccagaagat

SEQ ID NO: 55998 - DNA, 20 bp, Artificial Sequence
  sgRNA
  Slc38a4_17
tcgtcttatttgtgtccgtg

SEQ ID NO: 55999 - DNA, 20 bp, Artificial Sequence
  sgRNA
  Slc38a4_18
cgacggagacagctgcagcg

SEQ ID NO: 56000 - DNA, 20 bp, Artificial Sequence
  sgRNA
  Slc38a4_19
gatgatcccggtgttggcca

SEQ ID NO: 56001 - DNA, 20 bp, Artificial Sequence
  sgRNA
  Slc38a4_20
tggcgctcattatactcgac

SEQ ID NO: 56002 - DNA, 20 bp, Artificial Sequence
  sgRNA
  Slc38a5_1
agctacaggcaggaacgcga

SEQ ID NO: 56003 - DNA, 20 bp, Artificial Sequence
  sgRNA
  Slc38a5_2
acctgccgggaaagtagtcg

SEQ ID NO: 56004 - DNA, 20 bp, Artificial Sequence
  sgRNA
  Slc38a5_3
ggaaggtgccaataacaagg

SEQ ID NO: 56005 - DNA, 20 bp, Artificial Sequence
  sgRNA
  Slc38a5_4
acctcagcaacgctatcatg

SEQ ID NO: 56006 - DNA, 20 bp, Artificial Sequence
  sgRNA
  Slc38a5_5
cctcagtaggtacaatacgg

SEQ ID NO: 56007 - DNA, 20 bp, Artificial Sequence
  sgRNA
  Slc38a5_6
gtacggccagacgcacacaa

SEQ ID NO: 56008 - DNA, 20 bp, Artificial Sequence
  sgRNA
  Slc38a5_7
aggaaggtgccaataacaag

SEQ ID NO: 56009 - DNA, 20 bp, Artificial Sequence
  sgRNA
  Slc38a5_8
gctgtggccaacatgtccat

SEQ ID NO: 56010 - DNA, 20 bp, Artificial Sequence
  sgRNA
  Slc38a5_9
gcttatgccatggcacacac

SEQ ID NO: 56011 - DNA, 20 bp, Artificial Sequence
  sgRNA
  Slc38a5_10
gctggaaatgtacacccagg

SEQ ID NO: 56012 - DNA, 20 bp, Artificial Sequence
  sgRNA
  Slc38a5_11
tgcgtttgtctgccaccctg

SEQ ID NO: 56013 - DNA, 20 bp, Artificial Sequence
  sgRNA
  Slc38a5_12
gccacgactactttcccggc

SEQ ID NO: 56014 - DNA, 20 bp, Artificial Sequence
  sgRNA
  Slc38a5_13
ctggctctcatgaaacacct

SEQ ID NO: 56015 - DNA, 20 bp, Artificial Sequence
  sgRNA
  Slc38a5_14
ggcgtttaacagcagctgcg

SEQ ID NO: 56016 - DNA, 20 bp, Artificial Sequence
  sgRNA
  Slc38a5_15
tcatctgtctgcacaacgtt

SEQ ID NO: 56017 - DNA, 20 bp, Artificial Sequence
  sgRNA
  Slc38a5_16
aaacccaaagatatcgcgga

SEQ ID NO: 56018 - DNA, 20 bp, Artificial Sequence
  sgRNA
  Slc38a5_17
catctgtctgcacaacgttg

SEQ ID NO: 56019 - DNA, 20 bp, Artificial Sequence
  sgRNA
  Slc38a5_18
gagccacaatgacacagtag

SEQ ID NO: 56020 - DNA, 20 bp, Artificial Sequence
  sgRNA
  Slc38a5_19
gagagcaatgcacagcagca

SEQ ID NO: 56021 - DNA, 20 bp, Artificial Sequence
  sgRNA
  Slc38a5_20
tggttggcacacagatgacg

SEQ ID NO: 56022 - DNA, 20 bp, Artificial Sequence
  sgRNA
  Slc38a8_1
tcacggtgcaatactacctg

SEQ ID NO: 56023 - DNA, 20 bp, Artificial Sequence
  sgRNA
  Slc38a8_2
atttcccgaagtgctgacag

SEQ ID NO: 56024 - DNA, 20 bp, Artificial Sequence
  sgRNA
  Slc38a8_3
gctggtccccgatcactctg

SEQ ID NO: 56025 - DNA, 20 bp, Artificial Sequence
  sgRNA
  Slc38a8_4
tctttggtcttcctgatcag

SEQ ID NO: 56026 - DNA, 20 bp, Artificial Sequence
  sgRNA
  Slc38a8_5
gatctcacacagcttcccca

SEQ ID NO: 56027 - DNA, 20 bp, Artificial Sequence
  sgRNA
  Slc38a8_6
agagctactgggccacacgg

SEQ ID NO: 56028 - DNA, 20 bp, Artificial Sequence
  sgRNA
  Slc38a8_7
tccccaggaatagcacaatg

SEQ ID NO: 56029 - DNA, 20 bp, Artificial Sequence
  sgRNA
  Slc38a8_8
tgatctcgctgaggtccggc

SEQ ID NO: 56030 - DNA, 20 bp, Artificial Sequence
  sgRNA
  Slc38a8_9
cggcctgctcaacttcccct

SEQ ID NO: 56031 - DNA, 20 bp, Artificial Sequence
  sgRNA
  Slc38a8_10
gctgcagtagatggagacgg

SEQ ID NO: 56032 - DNA, 20 bp, Artificial Sequence
  sgRNA
  Slc38a8_11
tgagcgtcaccaccacccac

SEQ ID NO: 56033 - DNA, 20 bp, Artificial Sequence
  sgRNA
  Slc38a8_12
atagctcccggaccacaccc

SEQ ID NO: 56034 - DNA, 20 bp, Artificial Sequence
  sgRNA
  Slc38a8_13
gctgtggacacggaacccat

SEQ ID NO: 56035 - DNA, 20 bp, Artificial Sequence
  sgRNA
  Slc38a8_14
ctaatgatctcgctgaggtc

SEQ ID NO: 56036 - DNA, 20 bp, Artificial Sequence
  sgRNA
  Slc38a8_15
gcaaggacagcacagaaacc

SEQ ID NO: 56037 - DNA, 20 bp, Artificial Sequence
  sgRNA
  Slc38a8_16
ctttgggcagagcacagcgg

SEQ ID NO: 56038 - DNA, 20 bp, Artificial Sequence
  sgRNA
  Slc38a8_17
gatatcttaatgtcctaccc

SEQ ID NO: 56039 - DNA, 20 bp, Artificial Sequence
  sgRNA
  Slc38a8_18
cgtagcacgcgttctctttg

SEQ ID NO: 56040 - DNA, 20 bp, Artificial Sequence
  sgRNA
  Slc38a8_19
ggacttcaagaggatgaaca

SEQ ID NO: 56041 - DNA, 20 bp, Artificial Sequence
  sgRNA
  Slc38a8_20
accccattgtgctattcctg

SEQ ID NO: 56042 - DNA, 20 bp, Artificial Sequence
  sgRNA
  Slc38a9_1
gagacttgaccattgcccaa

SEQ ID NO: 56043 - DNA, 20 bp, Artificial Sequence
  sgRNA
  Slc38a9_2
tactcacatagtaactaagc

SEQ ID NO: 56044 - DNA, 20 bp, Artificial Sequence
  sgRNA
  Slc38a9_3
ttcacattgacaatgttggt

SEQ ID NO: 56045 - DNA, 20 bp, Artificial Sequence
  sgRNA
  Slc38a9_4
tgttcgcttaggattccatc

SEQ ID NO: 56046 - DNA, 20 bp, Artificial Sequence
  sgRNA
  Slc38a9_5
gtttctacccaaacatagga

SEQ ID NO: 56047 - DNA, 20 bp, Artificial Sequence
  sgRNA
  Slc38a9_6
gcagacatctggatattccc

SEQ ID NO: 56048 - DNA, 20 bp, Artificial Sequence
  sgRNA
  Slc38a9_7
cgagccaagtagcctaagag

SEQ ID NO: 56049 - DNA, 20 bp, Artificial Sequence
  sgRNA
  Slc38a9_8
ggtatatgaacacgaaagcc

SEQ ID NO: 56050 - DNA, 20 bp, Artificial Sequence
  sgRNA
  Slc38a9_9
ccagcatataagcaatgcat

SEQ ID NO: 56051 - DNA, 20 bp, Artificial Sequence
  sgRNA
  Slc38a9_10
ctttgggtaatggaggcgaa

SEQ ID NO: 56052 - DNA, 20 bp, Artificial Sequence
  sgRNA
  Slc38a9_11
ctaagttaagaatcagcaca

SEQ ID NO: 56053 - DNA, 20 bp, Artificial Sequence
  sgRNA
  Slc38a9_12
cagacgctcctcttggtgaa

SEQ ID NO: 56054 - DNA, 20 bp, Artificial Sequence
  sgRNA
  Slc38a9_13
actttactgctgctatagag

SEQ ID NO: 56055 - DNA, 20 bp, Artificial Sequence
  sgRNA
  Slc38a9_14
aggagccctataaggtagaa

SEQ ID NO: 56056 - DNA, 20 bp, Artificial Sequence
  sgRNA
  Slc38a9_15
tgtgaatgatgtcattcaga

SEQ ID NO: 56057 - DNA, 20 bp, Artificial Sequence
  sgRNA
  Slc38a9_16
actggatgttcataggccca

SEQ ID NO: 56058 - DNA, 20 bp, Artificial Sequence
  sgRNA
  Slc38a9_17
atgctgctgctatgaacaag

SEQ ID NO: 56059 - DNA, 20 bp, Artificial Sequence
  sgRNA
  Slc38a9_18
catcagatctgagatctaaa

SEQ ID NO: 56060 - DNA, 20 bp, Artificial Sequence
  sgRNA
  Slc38a9_19
tctatactaagtattccttg

SEQ ID NO: 56061 - DNA, 20 bp, Artificial Sequence
  sgRNA
  Slc38a9_20
tcagtttccgcagctgatgg

SEQ ID NO: 56062 - DNA, 20 bp, Artificial Sequence
  sgRNA
  Slc39a10_1
cgtgcgtatgctgatgactg

SEQ ID NO: 56063 - DNA, 20 bp, Artificial Sequence
  sgRNA
  Slc39a10_2
tgaacaatatgagcataacc

SEQ ID NO: 56064 - DNA, 20 bp, Artificial Sequence
  sgRNA
  Slc39a10_3
agtcgttgagattaatcacg

SEQ ID NO: 56065 - DNA, 20 bp, Artificial Sequence
  sgRNA
  Slc39a10_4
cgatctgatacagcaatgca

SEQ ID NO: 56066 - DNA, 20 bp, Artificial Sequence
  sgRNA
  Slc39a10_5
gcttaatgagactgaactga

SEQ ID NO: 56067 - DNA, 20 bp, Artificial Sequence
  sgRNA
  Slc39a10_6
agcttcacagacatcatcgt

SEQ ID NO: 56068 - DNA, 20 bp, Artificial Sequence
  sgRNA
  Slc39a10_7
acggacatggtcattcacat

SEQ ID NO: 56069 - DNA, 20 bp, Artificial Sequence
  sgRNA
  Slc39a10_8
tctgccatgatggcttacat

SEQ ID NO: 56070 - DNA, 20 bp, Artificial Sequence
  sgRNA
  Slc39a10_9
ccgttgctcacagtgagcat

SEQ ID NO: 56071 - DNA, 20 bp, Artificial Sequence
  sgRNA
  Slc39a10_10
tccgaactctcccatctcac

SEQ ID NO: 56072 - DNA, 20 bp, Artificial Sequence
  sgRNA
  Slc39a10_11
gcacaccattcatgagcacg

SEQ ID NO: 56073 - DNA, 20 bp, Artificial Sequence
  sgRNA
  Slc39a10_12
gatgtctgtgaagctcctca

SEQ ID NO: 56074 - DNA, 20 bp, Artificial Sequence
  sgRNA
  Slc39a10_13
gacattctggcagtgcaaga

SEQ ID NO: 56075 - DNA, 20 bp, Artificial Sequence
  sgRNA
  Slc39a10_14
actcggtagtctctgaagac

SEQ ID NO: 56076 - DNA, 20 bp, Artificial Sequence
  sgRNA
  Slc39a10_15
cacagtcatcagcatacgca

SEQ ID NO: 56077 - DNA, 20 bp, Artificial Sequence
  sgRNA
  Slc39a10_16
gttcactgtgatcatggttg

SEQ ID NO: 56078 - DNA, 20 bp, Artificial Sequence
  sgRNA
  Slc39a10_17
tgtttatcatcagctttgat

SEQ ID NO: 56079 - DNA, 20 bp, Artificial Sequence
  sgRNA
  Slc39a10_18
ggtggttatgtgaggtcacg

SEQ ID NO: 56080 - DNA, 20 bp, Artificial Sequence
  sgRNA
  Slc39a10_19
tgaagataagacaaatatag

SEQ ID NO: 56081 - DNA, 20 bp, Artificial Sequence
  sgRNA
  Slc39a10_20
gatgcgcatgaggatggcca

SEQ ID NO: 56082 - DNA, 20 bp, Artificial Sequence
  sgRNA
  Slc39a12_1
tgcacagcctactcggcctt

SEQ ID NO: 56083 - DNA, 20 bp, Artificial Sequence
  sgRNA
  Slc39a12_2
aatacctccatcaataccaa

SEQ ID NO: 56084 - DNA, 20 bp, Artificial Sequence
  sgRNA
  Slc39a12_3
agaatatggctacagtacag

SEQ ID NO: 56085 - DNA, 20 bp, Artificial Sequence
  sgRNA
  Slc39a12_4
tgcactgttactcacagctg

SEQ ID NO: 56086 - DNA, 20 bp, Artificial Sequence
  sgRNA
  Slc39a12_5
gccttcgcaggactgtacat

SEQ ID NO: 56087 - DNA, 20 bp, Artificial Sequence
  sgRNA
  Slc39a12_6
tgaacatgctcacgaccaga

SEQ ID NO: 56088 - DNA, 20 bp, Artificial Sequence
  sgRNA
  Slc39a12_7
cagacaactgtgctacccat

SEQ ID NO: 56089 - DNA, 20 bp, Artificial Sequence
  sgRNA
  Slc39a12_8
gaggctggcacattgcctat

SEQ ID NO: 56090 - DNA, 20 bp, Artificial Sequence
  sgRNA
  Slc39a12_9
tcttgtatcaccaaatacca

SEQ ID NO: 56091 - DNA, 20 bp, Artificial Sequence
  sgRNA
  Slc39a12_10
cggtctcagtagaggaaacg

SEQ ID NO: 56092 - DNA, 20 bp, Artificial Sequence
  sgRNA
  Slc39a12_11
tctggaccaatctttcagtg

SEQ ID NO: 56093 - DNA, 20 bp, Artificial Sequence
  sgRNA
  Slc39a12_12
gtatttatcctctttagcac

SEQ ID NO: 56094 - DNA, 20 bp, Artificial Sequence
  sgRNA
  Slc39a12_13
gctttcaccaggaagtactt

SEQ ID NO: 56095 - DNA, 20 bp, Artificial Sequence
  sgRNA
  Slc39a12_14
aagctgttgggactacttgg

SEQ ID NO: 56096 - DNA, 20 bp, Artificial Sequence
  sgRNA
  Slc39a12_15
agaagttgctggatgatccc

SEQ ID NO: 56097 - DNA, 20 bp, Artificial Sequence
  sgRNA
  Slc39a12_16
aggcctgctagaagttctga

SEQ ID NO: 56098 - DNA, 20 bp, Artificial Sequence
  sgRNA
  Slc39a12_17
ggaccaatccgacattctgc

SEQ ID NO: 56099 - DNA, 20 bp, Artificial Sequence
  sgRNA
  Slc39a12_18
agaaggctgtgcctattact

SEQ ID NO: 56100 - DNA, 20 bp, Artificial Sequence
  sgRNA
  Slc39a12_19
gcagtgacactcctaacctt

SEQ ID NO: 56101 - DNA, 20 bp, Artificial Sequence
  sgRNA
  Slc39a12_20
tttggaggatgagctaagag

SEQ ID NO: 56102 - DNA, 20 bp, Artificial Sequence
  sgRNA
  Slc39a14_1
gagcgagcgatctcagatcg

SEQ ID NO: 56103 - DNA, 20 bp, Artificial Sequence
  sgRNA
  Slc39a14_2
gtagagggttccaatcgcca

SEQ ID NO: 56104 - DNA, 20 bp, Artificial Sequence
  sgRNA
  Slc39a14_3
taaaatggttatgcccgtga

SEQ ID NO: 56105 - DNA, 20 bp, Artificial Sequence
  sgRNA
  Slc39a14_4
gtgaccgagaagctacagaa

SEQ ID NO: 56106 - DNA, 20 bp, Artificial Sequence
  sgRNA
  Slc39a14_5
gggagatgacggtaacgcag

SEQ ID NO: 56107 - DNA, 20 bp, Artificial Sequence
  sgRNA
  Slc39a14_6
gatgaatgaagtctgccagg

SEQ ID NO: 56108 - DNA, 20 bp, Artificial Sequence
  sgRNA
  Slc39a14_7
gagcagcgttccaatggaca

SEQ ID NO: 56109 - DNA, 20 bp, Artificial Sequence
  sgRNA
  Slc39a14_8
tccttccaagaaggaccagg

SEQ ID NO: 56110 - DNA, 20 bp, Artificial Sequence
  sgRNA
  Slc39a14_9
cctgctctacttcatagcct

SEQ ID NO: 56111 - DNA, 20 bp, Artificial Sequence
  sgRNA
  Slc39a14_10
ggataatgtttcccagccca

SEQ ID NO: 56112 - DNA, 20 bp, Artificial Sequence
  sgRNA
  Slc39a14_11
tcaagttgtgcgccgcaaag

SEQ ID NO: 56113 - DNA, 20 bp, Artificial Sequence
  sgRNA
  Slc39a14_12
ggttaatcagtgagacactg

SEQ ID NO: 56114 - DNA, 20 bp, Artificial Sequence
  sgRNA
  Slc39a14_13
taccaaacagcaccaacagg

SEQ ID NO: 56115 - DNA, 20 bp, Artificial Sequence
  sgRNA
  Slc39a14_14
taaaaagtcttcttcatgaa

SEQ ID NO: 56116 - DNA, 20 bp, Artificial Sequence
  sgRNA
  Slc39a14_15
cattgtgaggaccagcataa

SEQ ID NO: 56117 - DNA, 20 bp, Artificial Sequence
  sgRNA
  Slc39a14_16
ggcccccatgagggagcaga

SEQ ID NO: 56118 - DNA, 20 bp, Artificial Sequence
  sgRNA
  Slc39a14_17
tggatgatcaccctgagcga

SEQ ID NO: 56119 - DNA, 20 bp, Artificial Sequence
  sgRNA
  Slc39a14_18
gctcgctgttgcagtgctga

SEQ ID NO: 56120 - DNA, 20 bp, Artificial Sequence
  sgRNA
  Slc39a14_19
gcagccacttctctgcaaac

SEQ ID NO: 56121 - DNA, 20 bp, Artificial Sequence
  sgRNA
  Slc39a14_20
ggcccactcccacatgcagg

SEQ ID NO: 56122 - DNA, 20 bp, Artificial Sequence
  sgRNA
  Slc39a2_1
tccatagggatactccacct

SEQ ID NO: 56123 - DNA, 20 bp, Artificial Sequence
  sgRNA
  Slc39a2_2
tttattaggtcatcaccaca

SEQ ID NO: 56124 - DNA, 20 bp, Artificial Sequence
  sgRNA
  Slc39a2_3
tggattccacaagcatccag

SEQ ID NO: 56125 - DNA, 20 bp, Artificial Sequence
  sgRNA
  Slc39a2_4
ctgtatggtggccgccactg

SEQ ID NO: 56126 - DNA, 20 bp, Artificial Sequence
  sgRNA
  Slc39a2_5
gcaatgccagcgactccaaa

SEQ ID NO: 56127 - DNA, 20 bp, Artificial Sequence
  sgRNA
  Slc39a2_6
gcggtaccctcaccctcacg

SEQ ID NO: 56128 - DNA, 20 bp, Artificial Sequence
  sgRNA
  Slc39a2_7
ggagcctcaggacaaacaca

SEQ ID NO: 56129 - DNA, 20 bp, Artificial Sequence
  sgRNA
  Slc39a2_8
gagatgacgagctctccata

SEQ ID NO: 56130 - DNA, 20 bp, Artificial Sequence
  sgRNA
  Slc39a2_9
acaaacacagggattagccc

SEQ ID NO: 56131 - DNA, 20 bp, Artificial Sequence
  sgRNA
  Slc39a2_10
ggcattgcagtgctgtcacg

SEQ ID NO: 56132 - DNA, 20 bp, Artificial Sequence
  sgRNA
  Slc39a2_11
cctagccctggggctgaccg

SEQ ID NO: 56133 - DNA, 20 bp, Artificial Sequence
  sgRNA
  Slc39a2_12
ctagctctcatgtctcctgt

SEQ ID NO: 56134 - DNA, 20 bp, Artificial Sequence
  sgRNA
  Slc39a2_13
gacatataaaaacgtgccag

SEQ ID NO: 56135 - DNA, 20 bp, Artificial Sequence
  sgRNA
  Slc39a2_14
agcgacacagagctgtatgg

SEQ ID NO: 56136 - DNA, 20 bp, Artificial Sequence
  sgRNA
  Slc39a2_15
agaaggaccagggcgcgcaa

SEQ ID NO: 56137 - DNA, 20 bp, Artificial Sequence
  sgRNA
  Slc39a2_16
ctacgtgaaatggttccaga

SEQ ID NO: 56138 - DNA, 20 bp, Artificial Sequence
  sgRNA
  Slc39a2_17
gtattagagggcatagccgc

SEQ ID NO: 56139 - DNA, 20 bp, Artificial Sequence
  sgRNA
  Slc39a2_18
gtcgctgtgctggctcataa

SEQ ID NO: 56140 - DNA, 20 bp, Artificial Sequence
  sgRNA
  Slc39a2_19
gtactactaggagtaaaaat

SEQ ID NO: 56141 - DNA, 20 bp, Artificial Sequence
  sgRNA
  Slc39a2_20
tgagaaccagaagagcaagc

SEQ ID NO: 56142 - DNA, 20 bp, Artificial Sequence
  sgRNA
  Slc39a4_1
ggtcctgaatacggatagtg

SEQ ID NO: 56143 - DNA, 20 bp, Artificial Sequence
  sgRNA
  Slc39a4_2
cagttggggaagatctacac

SEQ ID NO: 56144 - DNA, 20 bp, Artificial Sequence
  sgRNA
  Slc39a4_3
catgcagcgtgatattggga

SEQ ID NO: 56145 - DNA, 20 bp, Artificial Sequence
  sgRNA
  Slc39a4_4
tggagagggtcacacccatg

SEQ ID NO: 56146 - DNA, 20 bp, Artificial Sequence
  sgRNA
  Slc39a4_5
tgatgaatgtgcgcgaccag

SEQ ID NO: 56147 - DNA, 20 bp, Artificial Sequence
  sgRNA
  Slc39a4_6
gcaggggtttccaaaagcgc

SEQ ID NO: 56148 - DNA, 20 bp, Artificial Sequence
  sgRNA
  Slc39a4_7
gttgccctatctgatcacac

SEQ ID NO: 56149 - DNA, 20 bp, Artificial Sequence
  sgRNA
  Slc39a4_8
ggacggcctgttaaatacgc

SEQ ID NO: 56150 - DNA, 20 bp, Artificial Sequence
  sgRNA
  Slc39a4_9
tgtggtcagcatgatcaccg

SEQ ID NO: 56151 - DNA, 20 bp, Artificial Sequence
  sgRNA
  Slc39a4_10
gggcgaggcttggattctgg

SEQ ID NO: 56152 - DNA, 20 bp, Artificial Sequence
  sgRNA
  Slc39a4_11
ggccagcccagtcttccacg

SEQ ID NO: 56153 - DNA, 20 bp, Artificial Sequence
  sgRNA
  Slc39a4_12
cttcaacctcttgttgccca

SEQ ID NO: 56154 - DNA, 20 bp, Artificial Sequence
  sgRNA
  Slc39a4_13
gcagtcggagtaggcgagga

SEQ ID NO: 56155 - DNA, 20 bp, Artificial Sequence
  sgRNA
  Slc39a4_14
agcattcgcaggcctctacg

SEQ ID NO: 56156 - DNA, 20 bp, Artificial Sequence
  sgRNA
  Slc39a4_15
ggccaggtaatcgtccacat

SEQ ID NO: 56157 - DNA, 20 bp, Artificial Sequence
  sgRNA
  Slc39a4_16
acttagctgctgctggacca

SEQ ID NO: 56158 - DNA, 20 bp, Artificial Sequence
  sgRNA
  Slc39a4_17
tgctggatcatgtcattaat

SEQ ID NO: 56159 - DNA, 20 bp, Artificial Sequence
  sgRNA
  Slc39a4_18
aaccggcctcttcctttacg

SEQ ID NO: 56160 - DNA, 20 bp, Artificial Sequence
  sgRNA
  Slc39a4_19
ccagctgcagagatattcca

SEQ ID NO: 56161 - DNA, 20 bp, Artificial Sequence
  sgRNA
  Slc39a4_20
tctgatcacactgggcgacg

SEQ ID NO: 56162 - DNA, 20 bp, Artificial Sequence
  sgRNA
  Slc39a5_1
cagcagagcgaactgacgag

SEQ ID NO: 56163 - DNA, 20 bp, Artificial Sequence
  sgRNA
  Slc39a5_2
aggacctagtgagcaatcag

SEQ ID NO: 56164 - DNA, 20 bp, Artificial Sequence
  sgRNA
  Slc39a5_3
gtggagacaatttcacacac

SEQ ID NO: 56165 - DNA, 20 bp, Artificial Sequence
  sgRNA
  Slc39a5_4
tcagatggtcagccaacgaa

SEQ ID NO: 56166 - DNA, 20 bp, Artificial Sequence
  sgRNA
  Slc39a5_5
ctaggactaggccgagtcca

SEQ ID NO: 56167 - DNA, 20 bp, Artificial Sequence
  sgRNA
  Slc39a5_6
gctgtcaatctgataaagca

SEQ ID NO: 56168 - DNA, 20 bp, Artificial Sequence
  sgRNA
  Slc39a5_7
acagcagagcgaactgacga

SEQ ID NO: 56169 - DNA, 20 bp, Artificial Sequence
  sgRNA
  Slc39a5_8
ggacaccatgagcctccaac

SEQ ID NO: 56170 - DNA, 20 bp, Artificial Sequence
  sgRNA
  Slc39a5_9
ttgccatgctgcttcaggaa

SEQ ID NO: 56171 - DNA, 20 bp, Artificial Sequence
  sgRNA
  Slc39a5_10
ccgtggtcccaaacacccag

SEQ ID NO: 56172 - DNA, 20 bp, Artificial Sequence
  sgRNA
  Slc39a5_11
gcctgcacaacctcaccgac

SEQ ID NO: 56173 - DNA, 20 bp, Artificial Sequence
  sgRNA
  Slc39a5_12
tgttccacgtgcttctgcag

SEQ ID NO: 56174 - DNA, 20 bp, Artificial Sequence
  sgRNA
  Slc39a5_13
ccaaaccctgacccagagga

SEQ ID NO: 56175 - DNA, 20 bp, Artificial Sequence
  sgRNA
  Slc39a5_14
acaggaacagaaccactacc

SEQ ID NO: 56176 - DNA, 20 bp, Artificial Sequence
  sgRNA
  Slc39a5_15
tgtgcaggcaatctcccagg

SEQ ID NO: 56177 - DNA, 20 bp, Artificial Sequence
  sgRNA
  Slc39a5_16
gatggtccttcgacccctac

SEQ ID NO: 56178 - DNA, 20 bp, Artificial Sequence
  sgRNA
  Slc39a5_17
atagaggaaaaccccagccg

SEQ ID NO: 56179 - DNA, 20 bp, Artificial Sequence
  sgRNA
  Slc39a5_18
accggggtggcagtatcgca

SEQ ID NO: 56180 - DNA, 20 bp, Artificial Sequence
  sgRNA
  Slc39a5_19
gttggctgaccatctgaatg

SEQ ID NO: 56181 - DNA, 20 bp, Artificial Sequence
  sgRNA
  Slc39a5_20
tctgctgttggaccattcgt

SEQ ID NO: 56182 - DNA, 20 bp, Artificial Sequence
  sgRNA
  Slc39a6_1
cgtggtccgagtgatgctcg

SEQ ID NO: 56183 - DNA, 20 bp, Artificial Sequence
  sgRNA
  Slc39a6_2
aggaatcattctctccgtag

SEQ ID NO: 56184 - DNA, 20 bp, Artificial Sequence
  sgRNA
  Slc39a6_3
cagccacggaacttacgtgt

SEQ ID NO: 56185 - DNA, 20 bp, Artificial Sequence
  sgRNA
  Slc39a6_4
gacagcgttgtataccgccg

SEQ ID NO: 56186 - DNA, 20 bp, Artificial Sequence
  sgRNA
  Slc39a6_5
gctcctctcgagagtagcgc

SEQ ID NO: 56187 - DNA, 20 bp, Artificial Sequence
  sgRNA
  Slc39a6_6
atatccctgttgccattcca

SEQ ID NO: 56188 - DNA, 20 bp, Artificial Sequence
  sgRNA
  Slc39a6_7
gttcctgctgagcttcctcg

SEQ ID NO: 56189 - DNA, 20 bp, Artificial Sequence
  sgRNA
  Slc39a6_8
tcacacttccacgatacgct

SEQ ID NO: 56190 - DNA, 20 bp, Artificial Sequence
  sgRNA
  Slc39a6_9
cagccagcgctactctcgag

SEQ ID NO: 56191 - DNA, 20 bp, Artificial Sequence
  sgRNA
  Slc39a6_10
ctatattctgagccgacagg

SEQ ID NO: 56192 - DNA, 20 bp, Artificial Sequence
  sgRNA
  Slc39a6_11
cctaccttggaatggcaaca

SEQ ID NO: 56193 - DNA, 20 bp, Artificial Sequence
  sgRNA
  Slc39a6_12
gcaggaacttgaaaaatacc

SEQ ID NO: 56194 - DNA, 20 bp, Artificial Sequence
  sgRNA
  Slc39a6_13
cgcccagcagagcacatgaa

SEQ ID NO: 56195 - DNA, 20 bp, Artificial Sequence
  sgRNA
  Slc39a6_14
cggttgctggtaaaaacaat

SEQ ID NO: 56196 - DNA, 20 bp, Artificial Sequence
  sgRNA
  Slc39a6_15
tcttcctcttccaacatcgt

SEQ ID NO: 56197 - DNA, 20 bp, Artificial Sequence
  sgRNA
  Slc39a6_16
tcatcaatcaaattgatgct

SEQ ID NO: 56198 - DNA, 20 bp, Artificial Sequence
  sgRNA
  Slc39a6_17
ttccgacggccagcgccacg

SEQ ID NO: 56199 - DNA, 20 bp, Artificial Sequence
  sgRNA
  Slc39a6_18
agccgtcagacctttccacg

SEQ ID NO: 56200 - DNA, 20 bp, Artificial Sequence
  sgRNA
  Slc39a6_19
atcgccactcagcgttccga

SEQ ID NO: 56201 - DNA, 20 bp, Artificial Sequence
  sgRNA
  Slc39a6_20
gcaggaagaaatatccccaa

SEQ ID NO: 56202 - DNA, 20 bp, Artificial Sequence
  sgRNA
  Slc39a8_1
tcagctgctgtaagatcgcg

SEQ ID NO: 56203 - DNA, 20 bp, Artificial Sequence
  sgRNA
  Slc39a8_2
agggggttaaaatcaatccc

SEQ ID NO: 56204 - DNA, 20 bp, Artificial Sequence
  sgRNA
  Slc39a8_3
cgttaggctcagtgacagcg

SEQ ID NO: 56205 - DNA, 20 bp, Artificial Sequence
  sgRNA
  Slc39a8_4
cggcgccaaccggagcctgt

SEQ ID NO: 56206 - DNA, 20 bp, Artificial Sequence
  sgRNA
  Slc39a8_5
tgagcgtgttcggcgccaac

SEQ ID NO: 56207 - DNA, 20 bp, Artificial Sequence
  sgRNA
  Slc39a8_6
tcttcatgatccagaatgca

SEQ ID NO: 56208 - DNA, 20 bp, Artificial Sequence
  sgRNA
  Slc39a8_7
tcccacgtagcaggaacacg

SEQ ID NO: 56209 - DNA, 20 bp, Artificial Sequence
  sgRNA
  Slc39a8_8
gccgtcgatgaaattgtgga

SEQ ID NO: 56210 - DNA, 20 bp, Artificial Sequence
  sgRNA
  Slc39a8_9
agcctgggacacccctcgga

SEQ ID NO: 56211 - DNA, 20 bp, Artificial Sequence
  sgRNA
  Slc39a8_10
catgaggaaactcctcacac

SEQ ID NO: 56212 - DNA, 20 bp, Artificial Sequence
  sgRNA
  Slc39a8_11
ttaccattgcctgcagtcaa

SEQ ID NO: 56213 - DNA, 20 bp, Artificial Sequence
  sgRNA
  Slc39a8_12
tcaatgcaggaatgagcacc

SEQ ID NO: 56214 - DNA, 20 bp, Artificial Sequence
  sgRNA
  Slc39a8_13
cagaatgcagggatgttaac

SEQ ID NO: 56215 - DNA, 20 bp, Artificial Sequence
  sgRNA
  Slc39a8_14
gatggcagagaagttcgagc

SEQ ID NO: 56216 - DNA, 20 bp, Artificial Sequence
  sgRNA
  Slc39a8_15
tgctttcttagatcctcgca

SEQ ID NO: 56217 - DNA, 20 bp, Artificial Sequence
  sgRNA
  Slc39a8_16
gctcatgtacctgtctgaag

SEQ ID NO: 56218 - DNA, 20 bp, Artificial Sequence
  sgRNA
  Slc39a8_17
gattgataattgtcactgac

SEQ ID NO: 56219 - DNA, 20 bp, Artificial Sequence
  sgRNA
  Slc39a8_18
gttcagctgctgtaagatcg

SEQ ID NO: 56220 - DNA, 20 bp, Artificial Sequence
  sgRNA
  Slc39a8_19
accggagctcgccttcagtg

SEQ ID NO: 56221 - DNA, 20 bp, Artificial Sequence
  sgRNA
  Slc39a8_20
ctccgcgtgttcctgctacg

SEQ ID NO: 56222 - DNA, 20 bp, Artificial Sequence
  sgRNA
  Slc39a9_1
gaaaacgaagcccaatacaa

SEQ ID NO: 56223 - DNA, 20 bp, Artificial Sequence
  sgRNA
  Slc39a9_2
aatgttggtgggatgttacg

SEQ ID NO: 56224 - DNA, 20 bp, Artificial Sequence
  sgRNA
  Slc39a9_3
cgtggcaataatgctacaca

SEQ ID NO: 56225 - DNA, 20 bp, Artificial Sequence
  sgRNA
  Slc39a9_4
agtgcacgcactttatgaag

SEQ ID NO: 56226 - DNA, 20 bp, Artificial Sequence
  sgRNA
  Slc39a9_5
ctttatgaagaggttctgga

SEQ ID NO: 56227 - DNA, 20 bp, Artificial Sequence
  sgRNA
  Slc39a9_6
ccaaaatcaccaccaccctg

SEQ ID NO: 56228 - DNA, 20 bp, Artificial Sequence
  sgRNA
  Slc39a9_7
ccagggctgccacctcaagg

SEQ ID NO: 56229 - DNA, 20 bp, Artificial Sequence
  sgRNA
  Slc39a9_8
tgagagaaccagacacaccc

SEQ ID NO: 56230 - DNA, 20 bp, Artificial Sequence
  sgRNA
  Slc39a9_9
cctgcagcctgggagctgcg

SEQ ID NO: 56231 - DNA, 20 bp, Artificial Sequence
  sgRNA
  Slc39a9_10
tgatgcatgctggtctggag

SEQ ID NO: 56232 - DNA, 20 bp, Artificial Sequence
  sgRNA
  Slc39a9_11
ctggcggtcatcgtcccgga

SEQ ID NO: 56233 - DNA, 20 bp, Artificial Sequence
  sgRNA
  Slc39a9_12
tttggctgttaatttctcag

SEQ ID NO: 56234 - DNA, 20 bp, Artificial Sequence
  sgRNA
  Slc39a9_13
acacagctacatgcctacat

SEQ ID NO: 56235 - DNA, 20 bp, Artificial Sequence
  sgRNA
  Slc39a9_14
agcatggacgactagcccca

SEQ ID NO: 56236 - DNA, 20 bp, Artificial Sequence
  sgRNA
  Slc39a9_15
gatgaggcaacccagaacca

SEQ ID NO: 56237 - DNA, 20 bp, Artificial Sequence
  sgRNA
  Slc39a9_16
ttgccacgaacacaattaac

SEQ ID NO: 56238 - DNA, 20 bp, Artificial Sequence
  sgRNA
  Slc39a9_17
cacaaacctgataccactgg

SEQ ID NO: 56239 - DNA, 20 bp, Artificial Sequence
  sgRNA
  Slc39a9_18
gacactagtttgtgaagtag

SEQ ID NO: 56240 - DNA, 20 bp, Artificial Sequence
  sgRNA
  Slc39a9_19
acaaacctgataccactgga

SEQ ID NO: 56241 - DNA, 20 bp, Artificial Sequence
  sgRNA
  Slc39a9_20
cagaccagcatgcatcagga

SEQ ID NO: 56242 - DNA, 20 bp, Artificial Sequence
  sgRNA
  Slc3a1_1
ccatataccagatctacccg

SEQ ID NO: 56243 - DNA, 20 bp, Artificial Sequence
  sgRNA
  Slc3a1_2
atccttggttccaatcgagt

SEQ ID NO: 56244 - DNA, 20 bp, Artificial Sequence
  sgRNA
  Slc3a1_3
agaggagcctcacctaaagg

SEQ ID NO: 56245 - DNA, 20 bp, Artificial Sequence
  sgRNA
  Slc3a1_4
tggcaagccatagtacatca

SEQ ID NO: 56246 - DNA, 20 bp, Artificial Sequence
  sgRNA
  Slc3a1_5
cctactcgagaagtcagccg

SEQ ID NO: 56247 - DNA, 20 bp, Artificial Sequence
  sgRNA
  Slc3a1_6
ctccaaaattcagaaccacg

SEQ ID NO: 56248 - DNA, 20 bp, Artificial Sequence
  sgRNA
  Slc3a1_7
ataacgttctggctctcgaa

SEQ ID NO: 56249 - DNA, 20 bp, Artificial Sequence
  sgRNA
  Slc3a1_8
gatcctcttctggctcaccg

SEQ ID NO: 56250 - DNA, 20 bp, Artificial Sequence
  sgRNA
  Slc3a1_9
gctctcgttgaaatttgtaa

SEQ ID NO: 56251 - DNA, 20 bp, Artificial Sequence
  sgRNA
  Slc3a1_10
ggttccaatcgagtaggaca

SEQ ID NO: 56252 - DNA, 20 bp, Artificial Sequence
  sgRNA
  Slc3a1_11
gtgtgtatggaaactccagc

SEQ ID NO: 56253 - DNA, 20 bp, Artificial Sequence
  sgRNA
  Slc3a1_12
ggaacgcccatcacttacta

SEQ ID NO: 56254 - DNA, 20 bp, Artificial Sequence
  sgRNA
  Slc3a1_13
gttgtgccagatgtagtaat

SEQ ID NO: 56255 - DNA, 20 bp, Artificial Sequence
  sgRNA
  Slc3a1_14
ggtggttacaccgttgacat

SEQ ID NO: 56256 - DNA, 20 bp, Artificial Sequence
  sgRNA
  Slc3a1_15
acagagctggtcctcagccg

SEQ ID NO: 56257 - DNA, 20 bp, Artificial Sequence
  sgRNA
  Slc3a1_16
tcaactgtgctaaatctaca

SEQ ID NO: 56258 - DNA, 20 bp, Artificial Sequence
  sgRNA
  Slc3a1_17
aggcggtgcggccctatgca

SEQ ID NO: 56259 - DNA, 20 bp, Artificial Sequence
  sgRNA
  Slc3a1_18
gagcaggaacacggaaacca

SEQ ID NO: 56260 - DNA, 20 bp, Artificial Sequence
  sgRNA
  Slc3a1_19
tcactgtccttaaaagacct

SEQ ID NO: 56261 - DNA, 20 bp, Artificial Sequence
  sgRNA
  Slc3a1_20
gcagggatactcacggcgtt

SEQ ID NO: 56262 - DNA, 20 bp, Artificial Sequence
  sgRNA
  Slc3a2_1
gttcaccggcttatccaagg

SEQ ID NO: 56263 - DNA, 20 bp, Artificial Sequence
  sgRNA
  Slc3a2_2
cgcccgaacgatgataacca

SEQ ID NO: 56264 - DNA, 20 bp, Artificial Sequence
  sgRNA
  Slc3a2_3
tatcaccaagaacttaagtg

SEQ ID NO: 56265 - DNA, 20 bp, Artificial Sequence
  sgRNA
  Slc3a2_4
gtactgaatccctagtcact

SEQ ID NO: 56266 - DNA, 20 bp, Artificial Sequence
  sgRNA
  Slc3a2_5
ggtccggtataaagtctgcg

SEQ ID NO: 56267 - DNA, 20 bp, Artificial Sequence
  sgRNA
  Slc3a2_6
tcaacttccgagattcgggc

SEQ ID NO: 56268 - DNA, 20 bp, Artificial Sequence
  sgRNA
  Slc3a2_7
gccgtgagctgcctgtacag

SEQ ID NO: 56269 - DNA, 20 bp, Artificial Sequence
  sgRNA
  Slc3a2_8
acaggcagctcacggcagcg

SEQ ID NO: 56270 - DNA, 20 bp, Artificial Sequence
  sgRNA
  Slc3a2_9
cggtctggtgaagatcaagg

SEQ ID NO: 56271 - DNA, 20 bp, Artificial Sequence
  sgRNA
  Slc3a2_10
actcctcgcagactttatac

SEQ ID NO: 56272 - DNA, 20 bp, Artificial Sequence
  sgRNA
  Slc3a2_11
aagatgctggactcattcca

SEQ ID NO: 56273 - DNA, 20 bp, Artificial Sequence
  sgRNA
  Slc3a2_12
gggtgctcaagtactccaga

SEQ ID NO: 56274 - DNA, 20 bp, Artificial Sequence
  sgRNA
  Slc3a2_13
tcatccccgtagctaaaaac

SEQ ID NO: 56275 - DNA, 20 bp, Artificial Sequence
  sgRNA
  Slc3a2_14
agtacgctccccagtgaaag

SEQ ID NO: 56276 - DNA, 20 bp, Artificial Sequence
  sgRNA
  Slc3a2_15
tgtgaattgggcctaacacc

SEQ ID NO: 56277 - DNA, 20 bp, Artificial Sequence
  sgRNA
  Slc3a2_16
cgaaggccccactcatgccg

SEQ ID NO: 56278 - DNA, 20 bp, Artificial Sequence
  sgRNA
  Slc3a2_17
tctggtgaagatcaaggtgg

SEQ ID NO: 56279 - DNA, 20 bp, Artificial Sequence
  sgRNA
  Slc3a2_18
taagccggtgaacttgaccc

SEQ ID NO: 56280 - DNA, 20 bp, Artificial Sequence
  sgRNA
  Slc3a2_19
gagagcgctccttaccccga

SEQ ID NO: 56281 - DNA, 20 bp, Artificial Sequence
  sgRNA
  Slc3a2_20
cctactgaacactccaccga

SEQ ID NO: 56282 - DNA, 20 bp, Artificial Sequence
  sgRNA
  Slc40a1_1
cagggtacgcctacactcag

SEQ ID NO: 56283 - DNA, 20 bp, Artificial Sequence
  sgRNA
  Slc40a1_2
cctttggattgtgatcgcag

SEQ ID NO: 56284 - DNA, 20 bp, Artificial Sequence
  sgRNA
  Slc40a1_3
tcatcaggatgattccgcag

SEQ ID NO: 56285 - DNA, 20 bp, Artificial Sequence
  sgRNA
  Slc40a1_4
cccatccatctcggaaagtg

SEQ ID NO: 56286 - DNA, 20 bp, Artificial Sequence
  sgRNA
  Slc40a1_5
catggacaccaaattccaac

SEQ ID NO: 56287 - DNA, 20 bp, Artificial Sequence
  sgRNA
  Slc40a1_6
actgagccaaaacctttgga

SEQ ID NO: 56288 - DNA, 20 bp, Artificial Sequence
  sgRNA
  Slc40a1_7
ccactgcgatcacaatccaa

SEQ ID NO: 56289 - DNA, 20 bp, Artificial Sequence
  sgRNA
  Slc40a1_8
gagaaacagacaggtccaag

SEQ ID NO: 56290 - DNA, 20 bp, Artificial Sequence
  sgRNA
  Slc40a1_9
gcaaaattcctcctctacct

SEQ ID NO: 56291 - DNA, 20 bp, Artificial Sequence
  sgRNA
  Slc40a1_10
agtggcccagacgtcactgg

SEQ ID NO: 56292 - DNA, 20 bp, Artificial Sequence
  sgRNA
  Slc40a1_11
atgctcccatcaaaatacta

SEQ ID NO: 56293 - DNA, 20 bp, Artificial Sequence
  sgRNA
  Slc40a1_12
gaagggctctgccatctggg

SEQ ID NO: 56294 - DNA, 20 bp, Artificial Sequence
  sgRNA
  Slc40a1_13
cactgcgatcacaatccaaa

SEQ ID NO: 56295 - DNA, 20 bp, Artificial Sequence
  sgRNA
  Slc40a1_14
aatgtgtccgtcatcctctg

SEQ ID NO: 56296 - DNA, 20 bp, Artificial Sequence
  sgRNA
  Slc40a1_15
acatgaatgctaccattaga

SEQ ID NO: 56297 - DNA, 20 bp, Artificial Sequence
  sgRNA
  Slc40a1_16
gcaggctgacagagactatg

SEQ ID NO: 56298 - DNA, 20 bp, Artificial Sequence
  sgRNA
  Slc40a1_17
tctgaaagaggcattatcaa

SEQ ID NO: 56299 - DNA, 20 bp, Artificial Sequence
  sgRNA
  Slc40a1_18
tgtgtaggaaaaccatcatc

SEQ ID NO: 56300 - DNA, 20 bp, Artificial Sequence
  sgRNA
  Slc40a1_19
tgccagccagaaacactggc

SEQ ID NO: 56301 - DNA, 20 bp, Artificial Sequence
  sgRNA
  Slc40a1_20
gagctcctgaccatgtacca

SEQ ID NO: 56302 - DNA, 20 bp, Artificial Sequence
  sgRNA
  Slc41a1_1
tgagtcccgagctaacgcca

SEQ ID NO: 56303 - DNA, 20 bp, Artificial Sequence
  sgRNA
  Slc41a1_2
tccccaggtacaagccacgg

SEQ ID NO: 56304 - DNA, 20 bp, Artificial Sequence
  sgRNA
  Slc41a1_3
ctggcgatacatctatcccc

SEQ ID NO: 56305 - DNA, 20 bp, Artificial Sequence
  sgRNA
  Slc41a1_4
tcattgggtctcgaaagatt

SEQ ID NO: 56306 - DNA, 20 bp, Artificial Sequence
  sgRNA
  Slc41a1_5
aaggacatccaccagccgaa

SEQ ID NO: 56307 - DNA, 20 bp, Artificial Sequence
  sgRNA
  Slc41a1_6
gacgatgtcagcacagaccg

SEQ ID NO: 56308 - DNA, 20 bp, Artificial Sequence
  sgRNA
  Slc41a1_7
agctctggcggatgatcacg

SEQ ID NO: 56309 - DNA, 20 bp, Artificial Sequence
  sgRNA
  Slc41a1_8
agtggacagcctcgacgcca

SEQ ID NO: 56310 - DNA, 20 bp, Artificial Sequence
  sgRNA
  Slc41a1_9
cagccattcctgcaaagttg

SEQ ID NO: 56311 - DNA, 20 bp, Artificial Sequence
  sgRNA
  Slc41a1_10
tgtacaggagaatcagcacc

SEQ ID NO: 56312 - DNA, 20 bp, Artificial Sequence
  sgRNA
  Slc41a1_11
agggatccagccaaagacga

SEQ ID NO: 56313 - DNA, 20 bp, Artificial Sequence
  sgRNA
  Slc41a1_12
tccacatgaacggcatgcca

SEQ ID NO: 56314 - DNA, 20 bp, Artificial Sequence
  sgRNA
  Slc41a1_13
ccagggccatccgaagaaca

SEQ ID NO: 56315 - DNA, 20 bp, Artificial Sequence
  sgRNA
  Slc41a1_14
ccttctccctgttcttcgga

SEQ ID NO: 56316 - DNA, 20 bp, Artificial Sequence
  sgRNA
  Slc41a1_15
acaaagaaggcacacaccag

SEQ ID NO: 56317 - DNA, 20 bp, Artificial Sequence
  sgRNA
  Slc41a1_16
cctgggcgacctcatcacct

SEQ ID NO: 56318 - DNA, 20 bp, Artificial Sequence
  sgRNA
  Slc41a1_17
ggagcctgtcatcattgcta

SEQ ID NO: 56319 - DNA, 20 bp, Artificial Sequence
  sgRNA
  Slc41a1_18
ctaccaccgtggcttgtacc

SEQ ID NO: 56320 - DNA, 20 bp, Artificial Sequence
  sgRNA
  Slc41a1_19
gtgacgatgtcagcacagac

SEQ ID NO: 56321 - DNA, 20 bp, Artificial Sequence
  sgRNA
  Slc41a1_20
gaaaaggaggtctccttgag

SEQ ID NO: 56322 - DNA, 20 bp, Artificial Sequence
  sgRNA
  Slc41a2_1
gctataactactgtgacggg

SEQ ID NO: 56323 - DNA, 20 bp, Artificial Sequence
  sgRNA
  Slc41a2_2
ttcatcgcatctctactgca

SEQ ID NO: 56324 - DNA, 20 bp, Artificial Sequence
  sgRNA
  Slc41a2_3
tgctaaaaagccaaccactg

SEQ ID NO: 56325 - DNA, 20 bp, Artificial Sequence
  sgRNA
  Slc41a2_4
atattagcttggataagtca

SEQ ID NO: 56326 - DNA, 20 bp, Artificial Sequence
  sgRNA
  Slc41a2_5
gaagcgatggaccatccagt

SEQ ID NO: 56327 - DNA, 20 bp, Artificial Sequence
  sgRNA
  Slc41a2_6
ggacgaagatctgtccagcg

SEQ ID NO: 56328 - DNA, 20 bp, Artificial Sequence
  sgRNA
  Slc41a2_7
gcagatcgcccagcgccgtg

SEQ ID NO: 56329 - DNA, 20 bp, Artificial Sequence
  sgRNA
  Slc41a2_8
ctataactactgtgacggga

SEQ ID NO: 56330 - DNA, 20 bp, Artificial Sequence
  sgRNA
  Slc41a2_9
ggagaccgagatggagacgt

SEQ ID NO: 56331 - DNA, 20 bp, Artificial Sequence
  sgRNA
  Slc41a2_10
tttctccatcccgtacctca

SEQ ID NO: 56332 - DNA, 20 bp, Artificial Sequence
  sgRNA
  Slc41a2_11
gctgtggatcgccgactgga

SEQ ID NO: 56333 - DNA, 20 bp, Artificial Sequence
  sgRNA
  Slc41a2_12
ttcgtcctgtaacatggcgg

SEQ ID NO: 56334 - DNA, 20 bp, Artificial Sequence
  sgRNA
  Slc41a2_13
tcatcaggtgaattgtgtag

SEQ ID NO: 56335 - DNA, 20 bp, Artificial Sequence
  sgRNA
  Slc41a2_14
tcctttaagaccaagaagcg

SEQ ID NO: 56336 - DNA, 20 bp, Artificial Sequence
  sgRNA
  Slc41a2_15
ccctgctgtggatcgccgac

SEQ ID NO: 56337 - DNA, 20 bp, Artificial Sequence
  sgRNA
  Slc41a2_16
gtatctgacccaaacttggt

SEQ ID NO: 56338 - DNA, 20 bp, Artificial Sequence
  sgRNA
  Slc41a2_17
gacgaagatctgtccagcga

SEQ ID NO: 56339 - DNA, 20 bp, Artificial Sequence
  sgRNA
  Slc41a2_18
gatgctatgtaaatggaggt

SEQ ID NO: 56340 - DNA, 20 bp, Artificial Sequence
  sgRNA
  Slc41a2_19
attagattccacttctcaat

SEQ ID NO: 56341 - DNA, 20 bp, Artificial Sequence
  sgRNA
  Slc41a2_20
ggagcctgtcataacagcca

SEQ ID NO: 56342 - DNA, 20 bp, Artificial Sequence
  sgRNA
  Slc41a3_1
ggagttcgattggtccaagg

SEQ ID NO: 56343 - DNA, 20 bp, Artificial Sequence
  sgRNA
  Slc41a3_2
tttcccttcagaccgacgag

SEQ ID NO: 56344 - DNA, 20 bp, Artificial Sequence
  sgRNA
  Slc41a3_3
ggtggatgccaaatcactgg

SEQ ID NO: 56345 - DNA, 20 bp, Artificial Sequence
  sgRNA
  Slc41a3_4
tctgcatagtgattggtgct

SEQ ID NO: 56346 - DNA, 20 bp, Artificial Sequence
  sgRNA
  Slc41a3_5
actgcatcccctacctcacg

SEQ ID NO: 56347 - DNA, 20 bp, Artificial Sequence
  sgRNA
  Slc41a3_6
ctaatgatctgcatagtgat

SEQ ID NO: 56348 - DNA, 20 bp, Artificial Sequence
  sgRNA
  Slc41a3_7
ggaccaatcgaactcctcgt

SEQ ID NO: 56349 - DNA, 20 bp, Artificial Sequence
  sgRNA
  Slc41a3_8
tgaagatcctgaagtatggg

SEQ ID NO: 56350 - DNA, 20 bp, Artificial Sequence
  sgRNA
  Slc41a3_9
gctccacatatgcagaaagg

SEQ ID NO: 56351 - DNA, 20 bp, Artificial Sequence
  sgRNA
  Slc41a3_10
gttggctctcagagaccgcc

SEQ ID NO: 56352 - DNA, 20 bp, Artificial Sequence
  sgRNA
  Slc41a3_11
agggacgtctccctgccagg

SEQ ID NO: 56353 - DNA, 20 bp, Artificial Sequence
  sgRNA
  Slc41a3_12
ggaagaagcacagtgccagc

SEQ ID NO: 56354 - DNA, 20 bp, Artificial Sequence
  sgRNA
  Slc41a3_13
cctggaccacgcctgccacc

SEQ ID NO: 56355 - DNA, 20 bp, Artificial Sequence
  sgRNA
  Slc41a3_14
acgttggtgccacccctcgt

SEQ ID NO: 56356 - DNA, 20 bp, Artificial Sequence
  sgRNA
  Slc41a3_15
gtttcccttcagaccgacga

SEQ ID NO: 56357 - DNA, 20 bp, Artificial Sequence
  sgRNA
  Slc41a3_16
tggaccaatcgaactcctcg

SEQ ID NO: 56358 - DNA, 20 bp, Artificial Sequence
  sgRNA
  Slc41a3_17
gctcagggaggatcccatga

SEQ ID NO: 56359 - DNA, 20 bp, Artificial Sequence
  sgRNA
  Slc41a3_18
gtccggcctgggcatgatga

SEQ ID NO: 56360 - DNA, 20 bp, Artificial Sequence
  sgRNA
  Slc41a3_19
gaagcttcttgccctgaaag

SEQ ID NO: 56361 - DNA, 20 bp, Artificial Sequence
  sgRNA
  Slc41a3_20
gattggtgctcggaagtttg

SEQ ID NO: 56362 - DNA, 20 bp, Artificial Sequence
  sgRNA
  Slc43a1_1
ggatatccctggtacctcag

SEQ ID NO: 56363 - DNA, 20 bp, Artificial Sequence
  sgRNA
  Slc43a1_2
ctgacccacaatggttacat

SEQ ID NO: 56364 - DNA, 20 bp, Artificial Sequence
  sgRNA
  Slc43a1_3
cttaacgtttacctcactca

SEQ ID NO: 56365 - DNA, 20 bp, Artificial Sequence
  sgRNA
  Slc43a1_4
cggtccatgagaattcccag

SEQ ID NO: 56366 - DNA, 20 bp, Artificial Sequence
  sgRNA
  Slc43a1_5
actcagccgctgacccacaa

SEQ ID NO: 56367 - DNA, 20 bp, Artificial Sequence
  sgRNA
  Slc43a1_6
gcggtacgcctgcttcagcg

SEQ ID NO: 56368 - DNA, 20 bp, Artificial Sequence
  sgRNA
  Slc43a1_7
tgaggtaccagggatatccg

SEQ ID NO: 56369 - DNA, 20 bp, Artificial Sequence
  sgRNA
  Slc43a1_8
ctgtgggtctaccaaattgg

SEQ ID NO: 56370 - DNA, 20 bp, Artificial Sequence
  sgRNA
  Slc43a1_9
cttgagcatgatcagcaggg

SEQ ID NO: 56371 - DNA, 20 bp, Artificial Sequence
  sgRNA
  Slc43a1_10
gcttcgggtcatcttctata

SEQ ID NO: 56372 - DNA, 20 bp, Artificial Sequence
  sgRNA
  Slc43a1_11
ggagaacctcttcttctccg

SEQ ID NO: 56373 - DNA, 20 bp, Artificial Sequence
  sgRNA
  Slc43a1_12
cactagaccacgctaccgca

SEQ ID NO: 56374 - DNA, 20 bp, Artificial Sequence
  sgRNA
  Slc43a1_13
ggtgaaggcattgatggcat

SEQ ID NO: 56375 - DNA, 20 bp, Artificial Sequence
  sgRNA
  Slc43a1_14
tgtgtggatgctccaacgga

SEQ ID NO: 56376 - DNA, 20 bp, Artificial Sequence
  sgRNA
  Slc43a1_15
ggagcaccgcggagaagaag

SEQ ID NO: 56377 - DNA, 20 bp, Artificial Sequence
  sgRNA
  Slc43a1_16
ggcgagaccggtagtagtag

SEQ ID NO: 56378 - DNA, 20 bp, Artificial Sequence
  sgRNA
  Slc43a1_17
atagaagatgacccgaagct

SEQ ID NO: 56379 - DNA, 20 bp, Artificial Sequence
  sgRNA
  Slc43a1_18
tgtcagtgtcccaaaatgat

SEQ ID NO: 56380 - DNA, 20 bp, Artificial Sequence
  sgRNA
  Slc43a1_19
tccggagtgtggaagcgccg

SEQ ID NO: 56381 - DNA, 20 bp, Artificial Sequence
  sgRNA
  Slc43a1_20
ggagtaacacagagtctccc

SEQ ID NO: 56382 - DNA, 20 bp, Artificial Sequence
  sgRNA
  Slc43a2_1
gtcactaacagcacggtcgg

SEQ ID NO: 56383 - DNA, 20 bp, Artificial Sequence
  sgRNA
  Slc43a2_2
gctttgaccacaagatcaca

SEQ ID NO: 56384 - DNA, 20 bp, Artificial Sequence
  sgRNA
  Slc43a2_3
cacactgtgcataaacgatg

SEQ ID NO: 56385 - DNA, 20 bp, Artificial Sequence
  sgRNA
  Slc43a2_4
ggaggtatagagggcaactg

SEQ ID NO: 56386 - DNA, 20 bp, Artificial Sequence
  sgRNA
  Slc43a2_5
caatggctcatccaaccggg

SEQ ID NO: 56387 - DNA, 20 bp, Artificial Sequence
  sgRNA
  Slc43a2_6
ttgtccatgatgatgcccag

SEQ ID NO: 56388 - DNA, 20 bp, Artificial Sequence
  sgRNA
  Slc43a2_7
gattcatccactctgccgta

SEQ ID NO: 56389 - DNA, 20 bp, Artificial Sequence
  sgRNA
  Slc43a2_8
agatcaatggctcatccaac

SEQ ID NO: 56390 - DNA, 20 bp, Artificial Sequence
  sgRNA
  Slc43a2_9
tctgaatttggccttcaccg

SEQ ID NO: 56391 - DNA, 20 bp, Artificial Sequence
  sgRNA
  Slc43a2_10
gtcctgcacacaattgtgcg

SEQ ID NO: 56392 - DNA, 20 bp, Artificial Sequence
  sgRNA
  Slc43a2_11
ggcagcgtataggcccccta

SEQ ID NO: 56393 - DNA, 20 bp, Artificial Sequence
  sgRNA
  Slc43a2_12
tgtaaaggcgaaggcccgca

SEQ ID NO: 56394 - DNA, 20 bp, Artificial Sequence
  sgRNA
  Slc43a2_13
catctgctaccggcgccagc

SEQ ID NO: 56395 - DNA, 20 bp, Artificial Sequence
  sgRNA
  Slc43a2_14
catccaccagcggcgccgat

SEQ ID NO: 56396 - DNA, 20 bp, Artificial Sequence
  sgRNA
  Slc43a2_15
gctgcgacttatcttctaca

SEQ ID NO: 56397 - DNA, 20 bp, Artificial Sequence
  sgRNA
  Slc43a2_16
agaaagtcacgaatgccatg

SEQ ID NO: 56398 - DNA, 20 bp, Artificial Sequence
  sgRNA
  Slc43a2_17
ccaatatgttcggcgacctt

SEQ ID NO: 56399 - DNA, 20 bp, Artificial Sequence
  sgRNA
  Slc43a2_18
ctcatcatgctcaagtccga

SEQ ID NO: 56400 - DNA, 20 bp, Artificial Sequence
  sgRNA
  Slc43a2_19
aacacactgtgcataaacga

SEQ ID NO: 56401 - DNA, 20 bp, Artificial Sequence
  sgRNA
  Slc43a2_20
tcatggacaagtatggtcca

SEQ ID NO: 56402 - DNA, 20 bp, Artificial Sequence
  sgRNA
  Slc43a3_1
tgaccgcttcaagactactg

SEQ ID NO: 56403 - DNA, 20 bp, Artificial Sequence
  sgRNA
  Slc43a3_2
gattcatcttgcacgtggtg

SEQ ID NO: 56404 - DNA, 20 bp, Artificial Sequence
  sgRNA
  Slc43a3_3
tgctccagagcaatgtaaca

SEQ ID NO: 56405 - DNA, 20 bp, Artificial Sequence
  sgRNA
  Slc43a3_4
tacccatagctgtagttggg

SEQ ID NO: 56406 - DNA, 20 bp, Artificial Sequence
  sgRNA
  Slc43a3_5
ctactcaccaagttatccgg

SEQ ID NO: 56407 - DNA, 20 bp, Artificial Sequence
  sgRNA
  Slc43a3_6
cggtcaaagatgtagccagt

SEQ ID NO: 56408 - DNA, 20 bp, Artificial Sequence
  sgRNA
  Slc43a3_7
tctgatacttctgtttaagg

SEQ ID NO: 56409 - DNA, 20 bp, Artificial Sequence
  sgRNA
  Slc43a3_8
actggactcttggaatgcat

SEQ ID NO: 56410 - DNA, 20 bp, Artificial Sequence
  sgRNA
  Slc43a3_9
tcgtcgattcatcttgcacg

SEQ ID NO: 56411 - DNA, 20 bp, Artificial Sequence
  sgRNA
  Slc43a3_10
actttccttctgatgcccaa

SEQ ID NO: 56412 - DNA, 20 bp, Artificial Sequence
  sgRNA
  Slc43a3_11
gggccacagtagtcttgaag

SEQ ID NO: 56413 - DNA, 20 bp, Artificial Sequence
  sgRNA
  Slc43a3_12
agcagctgaacacgaaacca

SEQ ID NO: 56414 - DNA, 20 bp, Artificial Sequence
  sgRNA
  Slc43a3_13
ccatgagtaagccattccag

SEQ ID NO: 56415 - DNA, 20 bp, Artificial Sequence
  sgRNA
  Slc43a3_14
atacacagcgttgctctcag

SEQ ID NO: 56416 - DNA, 20 bp, Artificial Sequence
  sgRNA
  Slc43a3_15
catgagtaagccattccagg

SEQ ID NO: 56417 - DNA, 20 bp, Artificial Sequence
  sgRNA
  Slc43a3_16
gttattcatgaaggatgcca

SEQ ID NO: 56418 - DNA, 20 bp, Artificial Sequence
  sgRNA
  Slc43a3_17
agtatcagaaggcagccaaa

SEQ ID NO: 56419 - DNA, 20 bp, Artificial Sequence
  sgRNA
  Slc43a3_18
tccattgtagagggtgatga

SEQ ID NO: 56420 - DNA, 20 bp, Artificial Sequence
  sgRNA
  Slc43a3_19
attcctcccactgcgagcat

SEQ ID NO: 56421 - DNA, 20 bp, Artificial Sequence
  sgRNA
  Slc43a3_20
gaccacttgcaggatgaagg

SEQ ID NO: 56422 - DNA, 20 bp, Artificial Sequence
  sgRNA
  Slc44a1_1
ctggaagcaataccgaacag

SEQ ID NO: 56423 - DNA, 20 bp, Artificial Sequence
  sgRNA
  Slc44a1_2
gtacatgtggtggtaccacg

SEQ ID NO: 56424 - DNA, 20 bp, Artificial Sequence
  sgRNA
  Slc44a1_3
gtggcacgggtgtattatgg

SEQ ID NO: 56425 - DNA, 20 bp, Artificial Sequence
  sgRNA
  Slc44a1_4
caccatcgccttgttccacg

SEQ ID NO: 56426 - DNA, 20 bp, Artificial Sequence
  sgRNA
  Slc44a1_5
agttctgtccatgatcctga

SEQ ID NO: 56427 - DNA, 20 bp, Artificial Sequence
  sgRNA
  Slc44a1_6
ccatatagaattctcggcca

SEQ ID NO: 56428 - DNA, 20 bp, Artificial Sequence
  sgRNA
  Slc44a1_7
atatccacagtcagctcaaa

SEQ ID NO: 56429 - DNA, 20 bp, Artificial Sequence
  sgRNA
  Slc44a1_8
gtgacaatagtgtcttacac

SEQ ID NO: 56430 - DNA, 20 bp, Artificial Sequence
  sgRNA
  Slc44a1_9
cttggttgtctgtatcacgc

SEQ ID NO: 56431 - DNA, 20 bp, Artificial Sequence
  sgRNA
  Slc44a1_10
tgagcagcttcagatagctg

SEQ ID NO: 56432 - DNA, 20 bp, Artificial Sequence
  sgRNA
  Slc44a1_11
gctgactgtggatatacatg

SEQ ID NO: 56433 - DNA, 20 bp, Artificial Sequence
  sgRNA
  Slc44a1_12
agccacgtggaacaaggcga

SEQ ID NO: 56434 - DNA, 20 bp, Artificial Sequence
  sgRNA
  Slc44a1_13
tcctcctcaccacctaccat

SEQ ID NO: 56435 - DNA, 20 bp, Artificial Sequence
  sgRNA
  Slc44a1_14
gctctgctccaggctttcaa

SEQ ID NO: 56436 - DNA, 20 bp, Artificial Sequence
  sgRNA
  Slc44a1_15
agtggagaacgctctgcgag

SEQ ID NO: 56437 - DNA, 20 bp, Artificial Sequence
  sgRNA
  Slc44a1_16
cgagagctaaagccgatggt

SEQ ID NO: 56438 - DNA, 20 bp, Artificial Sequence
  sgRNA
  Slc44a1_17
gtagctgcacagacatacca

SEQ ID NO: 56439 - DNA, 20 bp, Artificial Sequence
  sgRNA
  Slc44a1_18
tgttcacaggagcacagcga

SEQ ID NO: 56440 - DNA, 20 bp, Artificial Sequence
  sgRNA
  Slc44a1_19
gatagctgaggacaatctgc

SEQ ID NO: 56441 - DNA, 20 bp, Artificial Sequence
  sgRNA
  Slc44a1_20
tatacatgaggaccatcctg

SEQ ID NO: 56442 - DNA, 20 bp, Artificial Sequence
  sgRNA
  Slc44a2_1
atcaacaaccttgtacacgg

SEQ ID NO: 56443 - DNA, 20 bp, Artificial Sequence
  sgRNA
  Slc44a2_2
gaacattacagatctagtgg

SEQ ID NO: 56444 - DNA, 20 bp, Artificial Sequence
  sgRNA
  Slc44a2_3
ggtgaaacgcattacctgag

SEQ ID NO: 56445 - DNA, 20 bp, Artificial Sequence
  sgRNA
  Slc44a2_4
tcaagtgcaggtacactcgg

SEQ ID NO: 56446 - DNA, 20 bp, Artificial Sequence
  sgRNA
  Slc44a2_5
tttgcccacagaattcgccc

SEQ ID NO: 56447 - DNA, 20 bp, Artificial Sequence
  sgRNA
  Slc44a2_6
agtgttgcgcgcactcagaa

SEQ ID NO: 56448 - DNA, 20 bp, Artificial Sequence
  sgRNA
  Slc44a2_7
tggggtagatcaccttccga

SEQ ID NO: 56449 - DNA, 20 bp, Artificial Sequence
  sgRNA
  Slc44a2_8
gtaatcttcaaatatctgca

SEQ ID NO: 56450 - DNA, 20 bp, Artificial Sequence
  sgRNA
  Slc44a2_9
cgtcggagcctgcctctcca

SEQ ID NO: 56451 - DNA, 20 bp, Artificial Sequence
  sgRNA
  Slc44a2_10
gaaatgacggttcagccgag

SEQ ID NO: 56452 - DNA, 20 bp, Artificial Sequence
  sgRNA
  Slc44a2_11
atctaccccactgatagccg

SEQ ID NO: 56453 - DNA, 20 bp, Artificial Sequence
  sgRNA
  Slc44a2_12
ggtggaccttggcttccaga

SEQ ID NO: 56454 - DNA, 20 bp, Artificial Sequence
  sgRNA
  Slc44a2_13
attcgccccggctatcagtg

SEQ ID NO: 56455 - DNA, 20 bp, Artificial Sequence
  sgRNA
  Slc44a2_14
ggctcctacttgatcgcgca

SEQ ID NO: 56456 - DNA, 20 bp, Artificial Sequence
  sgRNA
  Slc44a2_15
aacattacagatctagtgga

SEQ ID NO: 56457 - DNA, 20 bp, Artificial Sequence
  sgRNA
  Slc44a2_16
aatgagacgacctatgagga

SEQ ID NO: 56458 - DNA, 20 bp, Artificial Sequence
  sgRNA
  Slc44a2_17
ctggaagccaaggtccacca

SEQ ID NO: 56459 - DNA, 20 bp, Artificial Sequence
  sgRNA
  Slc44a2_18
gcgaattctgtgggcaaaag

SEQ ID NO: 56460 - DNA, 20 bp, Artificial Sequence
  sgRNA
  Slc44a2_19
tcgtctcattgcccaccatg

SEQ ID NO: 56461 - DNA, 20 bp, Artificial Sequence
  sgRNA
  Slc44a2_20
cactcggatgatctgcacga

SEQ ID NO: 56462 - DNA, 20 bp, Artificial Sequence
  sgRNA
  Slc44a3_1
aggatggcacacgtccacag

SEQ ID NO: 56463 - DNA, 20 bp, Artificial Sequence
  sgRNA
  Slc44a3_2
gttcatcatgggttattcgg

SEQ ID NO: 56464 - DNA, 20 bp, Artificial Sequence
  sgRNA
  Slc44a3_3
gaaccggaaggcgaacaaca

SEQ ID NO: 56465 - DNA, 20 bp, Artificial Sequence
  sgRNA
  Slc44a3_4
ccaccacatataccgaatgc

SEQ ID NO: 56466 - DNA, 20 bp, Artificial Sequence
  sgRNA
  Slc44a3_5
gaaaatgcaccgatacaccg

SEQ ID NO: 56467 - DNA, 20 bp, Artificial Sequence
  sgRNA
  Slc44a3_6
atatctgtaccatctcaacc

SEQ ID NO: 56468 - DNA, 20 bp, Artificial Sequence
  sgRNA
  Slc44a3_7
gcgcagtttcaaacacggat

SEQ ID NO: 56469 - DNA, 20 bp, Artificial Sequence
  sgRNA
  Slc44a3_8
ttattccacttagaatccga

SEQ ID NO: 56470 - DNA, 20 bp, Artificial Sequence
  sgRNA
  Slc44a3_9
aagggtcgagatgaaccgga

SEQ ID NO: 56471 - DNA, 20 bp, Artificial Sequence
  sgRNA
  Slc44a3_10
aattcatccttgcatgccag

SEQ ID NO: 56472 - DNA, 20 bp, Artificial Sequence
  sgRNA
  Slc44a3_11
gggatgcaccggttaaataa

SEQ ID NO: 56473 - DNA, 20 bp, Artificial Sequence
  sgRNA
  Slc44a3_12
gcgggaagagacaccatcct

SEQ ID NO: 56474 - DNA, 20 bp, Artificial Sequence
  sgRNA
  Slc44a3_13
ctgctaccatcaaggaactg

SEQ ID NO: 56475 - DNA, 20 bp, Artificial Sequence
  sgRNA
  Slc44a3_14
ttggccaccttccatcacct

SEQ ID NO: 56476 - DNA, 20 bp, Artificial Sequence
  sgRNA
  Slc44a3_15
gatgctttaccaaatgaaga

SEQ ID NO: 56477 - DNA, 20 bp, Artificial Sequence
  sgRNA
  Slc44a3_16
gggttattcggtggtggccg

SEQ ID NO: 56478 - DNA, 20 bp, Artificial Sequence
  sgRNA
  Slc44a3_17
aatagcactcgggtgtctga

SEQ ID NO: 56479 - DNA, 20 bp, Artificial Sequence
  sgRNA
  Slc44a3_18
tcagcagcacagccacccag

SEQ ID NO: 56480 - DNA, 20 bp, Artificial Sequence
  sgRNA
  Slc44a3_19
gcaaacaaggaatagcactc

SEQ ID NO: 56481 - DNA, 20 bp, Artificial Sequence
  sgRNA
  Slc44a3_20
ccaggtccacagcaaagcac

SEQ ID NO: 56482 - DNA, 20 bp, Artificial Sequence
  sgRNA
  Slc44a4_1
tgggcacgaggaattcaacg

SEQ ID NO: 56483 - DNA, 20 bp, Artificial Sequence
  sgRNA
  Slc44a4_2
gatgtcgaagtatagaacgt

SEQ ID NO: 56484 - DNA, 20 bp, Artificial Sequence
  sgRNA
  Slc44a4_3
tctccatccccagatagtgg

SEQ ID NO: 56485 - DNA, 20 bp, Artificial Sequence
  sgRNA
  Slc44a4_4
agttggtagtgaagcccagt

SEQ ID NO: 56486 - DNA, 20 bp, Artificial Sequence
  sgRNA
  Slc44a4_5
ctaccccagaaactccacgg

SEQ ID NO: 56487 - DNA, 20 bp, Artificial Sequence
  sgRNA
  Slc44a4_6
ccgagggtctccatacaccc

SEQ ID NO: 56488 - DNA, 20 bp, Artificial Sequence
  sgRNA
  Slc44a4_7
ggaacacctccacagcccat

SEQ ID NO: 56489 - DNA, 20 bp, Artificial Sequence
  sgRNA
  Slc44a4_8
gcaaccccagtacatctact

SEQ ID NO: 56490 - DNA, 20 bp, Artificial Sequence
  sgRNA
  Slc44a4_9
tctaccccagaaactccacg

SEQ ID NO: 56491 - DNA, 20 bp, Artificial Sequence
  sgRNA
  Slc44a4_10
catgtagtaaggccgctcct

SEQ ID NO: 56492 - DNA, 20 bp, Artificial Sequence
  sgRNA
  Slc44a4_11
agatgatgcagcgggccaca

SEQ ID NO: 56493 - DNA, 20 bp, Artificial Sequence
  sgRNA
  Slc44a4_12
gcaaatgaccaggaggacga

SEQ ID NO: 56494 - DNA, 20 bp, Artificial Sequence
  sgRNA
  Slc44a4_13
agaagaatgaggcacctaca

SEQ ID NO: 56495 - DNA, 20 bp, Artificial Sequence
  sgRNA
  Slc44a4_14
acaggaacgttctcacagcc

SEQ ID NO: 56496 - DNA, 20 bp, Artificial Sequence
  sgRNA
  Slc44a4_15
aacccgggctatctgcacaa

SEQ ID NO: 56497 - DNA, 20 bp, Artificial Sequence
  sgRNA
  Slc44a4_16
aaccaatgcaaatgaccagg

SEQ ID NO: 56498 - DNA, 20 bp, Artificial Sequence
  sgRNA
  Slc44a4_17
tggggtagagcacttgccga

SEQ ID NO: 56499 - DNA, 20 bp, Artificial Sequence
  sgRNA
  Slc44a4_18
ggagcctacgtcattgccag

SEQ ID NO: 56500 - DNA, 20 bp, Artificial Sequence
  sgRNA
  Slc44a4_19
tgatggggcctcgaaaggag

SEQ ID NO: 56501 - DNA, 20 bp, Artificial Sequence
  sgRNA
  Slc44a4_20
gcggccttactacatgccca

SEQ ID NO: 56502 - DNA, 20 bp, Artificial Sequence
  sgRNA
  Slc44a5_1
ttgaagactatgctacctcg

SEQ ID NO: 56503 - DNA, 20 bp, Artificial Sequence
  sgRNA
  Slc44a5_2
actgggtagattaacgcact

SEQ ID NO: 56504 - DNA, 20 bp, Artificial Sequence
  sgRNA
  Slc44a5_3
tcaaagttatggtcccagcg

SEQ ID NO: 56505 - DNA, 20 bp, Artificial Sequence
  sgRNA
  Slc44a5_4
tggccatactcactcattgg

SEQ ID NO: 56506 - DNA, 20 bp, Artificial Sequence
  sgRNA
  Slc44a5_5
caaagttgcacgatgcaccg

SEQ ID NO: 56507 - DNA, 20 bp, Artificial Sequence
  sgRNA
  Slc44a5_6
ggtagattaacgcactggga

SEQ ID NO: 56508 - DNA, 20 bp, Artificial Sequence
  sgRNA
  Slc44a5_7
gactatgctagaattcaggg

SEQ ID NO: 56509 - DNA, 20 bp, Artificial Sequence
  sgRNA
  Slc44a5_8
gaagacctagaaagaaacga

SEQ ID NO: 56510 - DNA, 20 bp, Artificial Sequence
  sgRNA
  Slc44a5_9
tgtatggcttcgggattcag

SEQ ID NO: 56511 - DNA, 20 bp, Artificial Sequence
  sgRNA
  Slc44a5_10
agtacagcagcattcagcag

SEQ ID NO: 56512 - DNA, 20 bp, Artificial Sequence
  sgRNA
  Slc44a5_11
tggcgtccaggtaccattga

SEQ ID NO: 56513 - DNA, 20 bp, Artificial Sequence
  sgRNA
  Slc44a5_12
agagccggagtcacgaaata

SEQ ID NO: 56514 - DNA, 20 bp, Artificial Sequence
  sgRNA
  Slc44a5_13
ttagtgatctgatcaatgcc

SEQ ID NO: 56515 - DNA, 20 bp, Artificial Sequence
  sgRNA
  Slc44a5_14
aactgggtagattaacgcac

SEQ ID NO: 56516 - DNA, 20 bp, Artificial Sequence
  sgRNA
  Slc44a5_15
cgtagcccaaaataaacagt

SEQ ID NO: 56517 - DNA, 20 bp, Artificial Sequence
  sgRNA
  Slc44a5_16
ccacttggatccgagtcctg

SEQ ID NO: 56518 - DNA, 20 bp, Artificial Sequence
  sgRNA
  Slc44a5_17
attcaaagttatggtcccag

SEQ ID NO: 56519 - DNA, 20 bp, Artificial Sequence
  sgRNA
  Slc44a5_18
aggtatgacccagatttcca

SEQ ID NO: 56520 - DNA, 20 bp, Artificial Sequence
  sgRNA
  Slc44a5_19
gatcactttaaacatctgaa

SEQ ID NO: 56521 - DNA, 20 bp, Artificial Sequence
  sgRNA
  Slc44a5_20
ggcccagtaataggaagcaa

SEQ ID NO: 56522 - DNA, 20 bp, Artificial Sequence
  sgRNA
  Slc45a2_1
gcatgtttactaatgcccga

SEQ ID NO: 56523 - DNA, 20 bp, Artificial Sequence
  sgRNA
  Slc45a2_2
ctgggccataagcatcacca

SEQ ID NO: 56524 - DNA, 20 bp, Artificial Sequence
  sgRNA
  Slc45a2_3
ggcacccaaaatgtagccaa

SEQ ID NO: 56525 - DNA, 20 bp, Artificial Sequence
  sgRNA
  Slc45a2_4
ggagcaggaatcccaagatg

SEQ ID NO: 56526 - DNA, 20 bp, Artificial Sequence
  sgRNA
  Slc45a2_5
ctacggtgcacacaactcca

SEQ ID NO: 56527 - DNA, 20 bp, Artificial Sequence
  sgRNA
  Slc45a2_6
tacctatcaatccttagccg

SEQ ID NO: 56528 - DNA, 20 bp, Artificial Sequence
  sgRNA
  Slc45a2_7
gctcgtcgctgtcagccagt

SEQ ID NO: 56529 - DNA, 20 bp, Artificial Sequence
  sgRNA
  Slc45a2_8
accgtattcatgcatcccac

SEQ ID NO: 56530 - DNA, 20 bp, Artificial Sequence
  sgRNA
  Slc45a2_9
gctgacagcgacgagccctg

SEQ ID NO: 56531 - DNA, 20 bp, Artificial Sequence
  sgRNA
  Slc45a2_10
atacgaccgcatctccattg

SEQ ID NO: 56532 - DNA, 20 bp, Artificial Sequence
  sgRNA
  Slc45a2_11
agcaacccaagagatccaca

SEQ ID NO: 56533 - DNA, 20 bp, Artificial Sequence
  sgRNA
  Slc45a2_12
gcctaagagcctgtacagca

SEQ ID NO: 56534 - DNA, 20 bp, Artificial Sequence
  sgRNA
  Slc45a2_13
gtataccatggggatcccta

SEQ ID NO: 56535 - DNA, 20 bp, Artificial Sequence
  sgRNA
  Slc45a2_14
gtggagttgtgtgcaccgta

SEQ ID NO: 56536 - DNA, 20 bp, Artificial Sequence
  sgRNA
  Slc45a2_15
tcactggctgatcccaccac

SEQ ID NO: 56537 - DNA, 20 bp, Artificial Sequence
  sgRNA
  Slc45a2_16
gctcagatcttggttggagg

SEQ ID NO: 56538 - DNA, 20 bp, Artificial Sequence
  sgRNA
  Slc45a2_17
gcaaaactctcggccaaaca

SEQ ID NO: 56539 - DNA, 20 bp, Artificial Sequence
  sgRNA
  Slc45a2_18
ctgacagcgacgagccctga

SEQ ID NO: 56540 - DNA, 20 bp, Artificial Sequence
  sgRNA
  Slc45a2_19
tgataggtatgggtgtcagt

SEQ ID NO: 56541 - DNA, 20 bp, Artificial Sequence
  sgRNA
  Slc45a2_20
cattcccaagagcatcataa

SEQ ID NO: 56542 - DNA, 20 bp, Artificial Sequence
  sgRNA
  Slc45a4_1
aggtcgctcatgcttcggga

SEQ ID NO: 56543 - DNA, 20 bp, Artificial Sequence
  sgRNA
  Slc45a4_2
cgtagccaatggccccacca

SEQ ID NO: 56544 - DNA, 20 bp, Artificial Sequence
  sgRNA
  Slc45a4_3
gcatgacccataggcgtgtg

SEQ ID NO: 56545 - DNA, 20 bp, Artificial Sequence
  sgRNA
  Slc45a4_4
ggaaaagtgcaacaccaatg

SEQ ID NO: 56546 - DNA, 20 bp, Artificial Sequence
  sgRNA
  Slc45a4_5
ataccgccgggccaacgcag

SEQ ID NO: 56547 - DNA, 20 bp, Artificial Sequence
  sgRNA
  Slc45a4_6
gctaaagtcccaaatgggag

SEQ ID NO: 56548 - DNA, 20 bp, Artificial Sequence
  sgRNA
  Slc45a4_7
gctcatcgagacaacaccca

SEQ ID NO: 56549 - DNA, 20 bp, Artificial Sequence
  sgRNA
  Slc45a4_8
aatgggcccttcagttgcat

SEQ ID NO: 56550 - DNA, 20 bp, Artificial Sequence
  sgRNA
  Slc45a4_9
aatccacgcttggaattccc

SEQ ID NO: 56551 - DNA, 20 bp, Artificial Sequence
  sgRNA
  Slc45a4_10
aagaggagaccacaagcgag

SEQ ID NO: 56552 - DNA, 20 bp, Artificial Sequence
  sgRNA
  Slc45a4_11
tcagtgccgatgcaactgaa

SEQ ID NO: 56553 - DNA, 20 bp, Artificial Sequence
  sgRNA
  Slc45a4_12
gcttcaagtctaccttggag

SEQ ID NO: 56554 - DNA, 20 bp, Artificial Sequence
  sgRNA
  Slc45a4_13
ccgcctgtccacgttcctca

SEQ ID NO: 56555 - DNA, 20 bp, Artificial Sequence
  sgRNA
  Slc45a4_14
gcgtctggaaccagtcacct

SEQ ID NO: 56556 - DNA, 20 bp, Artificial Sequence
  sgRNA
  Slc45a4_15
attcctggtcatctaccctg

SEQ ID NO: 56557 - DNA, 20 bp, Artificial Sequence
  sgRNA
  Slc45a4_16
taggttcctctgacacctca

SEQ ID NO: 56558 - DNA, 20 bp, Artificial Sequence
  sgRNA
  Slc45a4_17
tctagcaccttctcctacta

SEQ ID NO: 56559 - DNA, 20 bp, Artificial Sequence
  sgRNA
  Slc45a4_18
gcccattcgtgcctacctgc

SEQ ID NO: 56560 - DNA, 20 bp, Artificial Sequence
  sgRNA
  Slc45a4_19
atggaaccagatgtgactga

SEQ ID NO: 56561 - DNA, 20 bp, Artificial Sequence
  sgRNA
  Slc45a4_20
acacgcctatgggtcatgca

SEQ ID NO: 56562 - DNA, 20 bp, Artificial Sequence
  sgRNA
  Slc46a1_1
agagctaacatctgccacag

SEQ ID NO: 56563 - DNA, 20 bp, Artificial Sequence
  sgRNA
  Slc46a1_2
gggcaatggatcgatgatgg

SEQ ID NO: 56564 - DNA, 20 bp, Artificial Sequence
  sgRNA
  Slc46a1_3
tggaccagaagagtcccacc

SEQ ID NO: 56565 - DNA, 20 bp, Artificial Sequence
  sgRNA
  Slc46a1_4
gaactgtgggaaccaaagcg

SEQ ID NO: 56566 - DNA, 20 bp, Artificial Sequence
  sgRNA
  Slc46a1_5
ccacagtcgcaccttccgga

SEQ ID NO: 56567 - DNA, 20 bp, Artificial Sequence
  sgRNA
  Slc46a1_6
gccactctgaacttcatgaa

SEQ ID NO: 56568 - DNA, 20 bp, Artificial Sequence
  sgRNA
  Slc46a1_7
gccatcatcgatccattgcc

SEQ ID NO: 56569 - DNA, 20 bp, Artificial Sequence
  sgRNA
  Slc46a1_8
cctttggcaccggttcagca

SEQ ID NO: 56570 - DNA, 20 bp, Artificial Sequence
  sgRNA
  Slc46a1_9
ggagcgttgaggaaactgtg

SEQ ID NO: 56571 - DNA, 20 bp, Artificial Sequence
  sgRNA
  Slc46a1_10
ctaaccacagtcgcaccttc

SEQ ID NO: 56572 - DNA, 20 bp, Artificial Sequence
  sgRNA
  Slc46a1_11
tggaccctctacatgaacgt

SEQ ID NO: 56573 - DNA, 20 bp, Artificial Sequence
  sgRNA
  Slc46a1_12
gcggagcgtgaaaagcctgg

SEQ ID NO: 56574 - DNA, 20 bp, Artificial Sequence
  sgRNA
  Slc46a1_13
ctggaccctctacatgaacg

SEQ ID NO: 56575 - DNA, 20 bp, Artificial Sequence
  sgRNA
  Slc46a1_14
ggaagactaggggctccacg

SEQ ID NO: 56576 - DNA, 20 bp, Artificial Sequence
  sgRNA
  Slc46a1_15
gagcggtccctgcagaacca

SEQ ID NO: 56577 - DNA, 20 bp, Artificial Sequence
  sgRNA
  Slc46a1_16
ttccagcagagccatccgga

SEQ ID NO: 56578 - DNA, 20 bp, Artificial Sequence
  sgRNA
  Slc46a1_17
gctctgctggaagcatgcat

SEQ ID NO: 56579 - DNA, 20 bp, Artificial Sequence
  sgRNA
  Slc46a1_18
ggttcccacagttctcccgg

SEQ ID NO: 56580 - DNA, 20 bp, Artificial Sequence
  sgRNA
  Slc46a1_19
gggagcctggagtgaccgcg

SEQ ID NO: 56581 - DNA, 20 bp, Artificial Sequence
  sgRNA
  Slc46a1_20
atagagccatgacaatcagc

SEQ ID NO: 56582 - DNA, 20 bp, Artificial Sequence
  sgRNA
  Slc46a2_1
gatgggcacctatcgaaccc

SEQ ID NO: 56583 - DNA, 20 bp, Artificial Sequence
  sgRNA
  Slc46a2_2
catgaccccggaccaataag

SEQ ID NO: 56584 - DNA, 20 bp, Artificial Sequence
  sgRNA
  Slc46a2_3
agcccaggactaaatcgatg

SEQ ID NO: 56585 - DNA, 20 bp, Artificial Sequence
  sgRNA
  Slc46a2_4
ggagtagtcctgcgtcgtag

SEQ ID NO: 56586 - DNA, 20 bp, Artificial Sequence
  sgRNA
  Slc46a2_5
tggcctacaaacaagtcccg

SEQ ID NO: 56587 - DNA, 20 bp, Artificial Sequence
  sgRNA
  Slc46a2_6
tgcagatagagatcttacgg

SEQ ID NO: 56588 - DNA, 20 bp, Artificial Sequence
  sgRNA
  Slc46a2_7
gaggcgtcaggcccagcacg

SEQ ID NO: 56589 - DNA, 20 bp, Artificial Sequence
  sgRNA
  Slc46a2_8
cctgatactccaccagcgac

SEQ ID NO: 56590 - DNA, 20 bp, Artificial Sequence
  sgRNA
  Slc46a2_9
ttattccgatcacaaccatc

SEQ ID NO: 56591 - DNA, 20 bp, Artificial Sequence
  sgRNA
  Slc46a2_10
cttctccgcttattggtccg

SEQ ID NO: 56592 - DNA, 20 bp, Artificial Sequence
  sgRNA
  Slc46a2_11
gcagagcaacaacttccctt

SEQ ID NO: 56593 - DNA, 20 bp, Artificial Sequence
  sgRNA
  Slc46a2_12
gctcaatccaagtcctcacc

SEQ ID NO: 56594 - DNA, 20 bp, Artificial Sequence
  sgRNA
  Slc46a2_13
cttacgctggacaagttcat

SEQ ID NO: 56595 - DNA, 20 bp, Artificial Sequence
  sgRNA
  Slc46a2_14
gagtagtcctgcgtcgtaga

SEQ ID NO: 56596 - DNA, 20 bp, Artificial Sequence
  sgRNA
  Slc46a2_15
tagagatcttacggtggtag

SEQ ID NO: 56597 - DNA, 20 bp, Artificial Sequence
  sgRNA
  Slc46a2_16
ccagacacagtatctacagt

SEQ ID NO: 56598 - DNA, 20 bp, Artificial Sequence
  sgRNA
  Slc46a2_17
gcagcgctcaatgggctatg

SEQ ID NO: 56599 - DNA, 20 bp, Artificial Sequence
  sgRNA
  Slc46a2_18
tctatctgcacagcgatgct

SEQ ID NO: 56600 - DNA, 20 bp, Artificial Sequence
  sgRNA
  Slc46a2_19
atactccaccagcgactggt

SEQ ID NO: 56601 - DNA, 20 bp, Artificial Sequence
  sgRNA
  Slc46a2_20
gctgacctgatggttgtgat

SEQ ID NO: 56602 - DNA, 20 bp, Artificial Sequence
  sgRNA
  Slc46a3_1
cagcgcagtacgtgtaccgg

SEQ ID NO: 56603 - DNA, 20 bp, Artificial Sequence
  sgRNA
  Slc46a3_2
tgctggaatgaggtttacat

SEQ ID NO: 56604 - DNA, 20 bp, Artificial Sequence
  sgRNA
  Slc46a3_3
ttagcgagcagcgacaacca

SEQ ID NO: 56605 - DNA, 20 bp, Artificial Sequence
  sgRNA
  Slc46a3_4
caggttgactataagaacca

SEQ ID NO: 56606 - DNA, 20 bp, Artificial Sequence
  sgRNA
  Slc46a3_5
cgagcagcgacaaccacgga

SEQ ID NO: 56607 - DNA, 20 bp, Artificial Sequence
  sgRNA
  Slc46a3_6
gctgctcgctaaaagcatga

SEQ ID NO: 56608 - DNA, 20 bp, Artificial Sequence
  sgRNA
  Slc46a3_7
gtaaatcccactgtacgcag

SEQ ID NO: 56609 - DNA, 20 bp, Artificial Sequence
  sgRNA
  Slc46a3_8
ccacggacggaaacttccca

SEQ ID NO: 56610 - DNA, 20 bp, Artificial Sequence
  sgRNA
  Slc46a3_9
gaagcaagctccccagaacg

SEQ ID NO: 56611 - DNA, 20 bp, Artificial Sequence
  sgRNA
  Slc46a3_10
ttaaaaatggttccagtaag

SEQ ID NO: 56612 - DNA, 20 bp, Artificial Sequence
  sgRNA
  Slc46a3_11
cttcgacctctgcgtacagt

SEQ ID NO: 56613 - DNA, 20 bp, Artificial Sequence
  sgRNA
  Slc46a3_12
gccagggtaccaggcaacag

SEQ ID NO: 56614 - DNA, 20 bp, Artificial Sequence
  sgRNA
  Slc46a3_13
aggcactcatttccacctgc

SEQ ID NO: 56615 - DNA, 20 bp, Artificial Sequence
  sgRNA
  Slc46a3_14
gtactgcgctgtcagcggga

SEQ ID NO: 56616 - DNA, 20 bp, Artificial Sequence
  sgRNA
  Slc46a3_15
acagcaggaagatgaagcca

SEQ ID NO: 56617 - DNA, 20 bp, Artificial Sequence
  sgRNA
  Slc46a3_16
cctcattccagcagagcgga

SEQ ID NO: 56618 - DNA, 20 bp, Artificial Sequence
  sgRNA
  Slc46a3_17
acacgtactgcgctgtcagc

SEQ ID NO: 56619 - DNA, 20 bp, Artificial Sequence
  sgRNA
  Slc46a3_18
cgtggtgtaattcccaaaga

SEQ ID NO: 56620 - DNA, 20 bp, Artificial Sequence
  sgRNA
  Slc46a3_19
taaacctcattccagcagag

SEQ ID NO: 56621 - DNA, 20 bp, Artificial Sequence
  sgRNA
  Slc46a3_20
gctttcttagaaacgctggc

SEQ ID NO: 56622 - DNA, 20 bp, Artificial Sequence
  sgRNA
  Slc47a1_1
agccagaacttaaagcacgt

SEQ ID NO: 56623 - DNA, 20 bp, Artificial Sequence
  sgRNA
  Slc47a1_2
gaagatcatgacgtaagtct

SEQ ID NO: 56624 - DNA, 20 bp, Artificial Sequence
  sgRNA
  Slc47a1_3
gggcgcaggaaacattgacc

SEQ ID NO: 56625 - DNA, 20 bp, Artificial Sequence
  sgRNA
  Slc47a1_4
gcgatgcccgtcataatctg

SEQ ID NO: 56626 - DNA, 20 bp, Artificial Sequence
  sgRNA
  Slc47a1_5
gccaatgacataatacccga

SEQ ID NO: 56627 - DNA, 20 bp, Artificial Sequence
  sgRNA
  Slc47a1_6
tctgaggcagaacgatgccc

SEQ ID NO: 56628 - DNA, 20 bp, Artificial Sequence
  sgRNA
  Slc47a1_7
gttctgcctcagattatgac

SEQ ID NO: 56629 - DNA, 20 bp, Artificial Sequence
  sgRNA
  Slc47a1_8
ggtgggacacagcataaatg

SEQ ID NO: 56630 - DNA, 20 bp, Artificial Sequence
  sgRNA
  Slc47a1_9
gatcccttcaggcttcagtg

SEQ ID NO: 56631 - DNA, 20 bp, Artificial Sequence
  sgRNA
  Slc47a1_10
tgagccgagcaataaaagcc

SEQ ID NO: 56632 - DNA, 20 bp, Artificial Sequence
  sgRNA
  Slc47a1_11
aataaaagccaggaagcacg

SEQ ID NO: 56633 - DNA, 20 bp, Artificial Sequence
  sgRNA
  Slc47a1_12
tgccaatttgaaggtaaacg

SEQ ID NO: 56634 - DNA, 20 bp, Artificial Sequence
  sgRNA
  Slc47a1_13
ctaggctgtaaggatctcgt

SEQ ID NO: 56635 - DNA, 20 bp, Artificial Sequence
  sgRNA
  Slc47a1_14
gcagcaggcagcgtagccca

SEQ ID NO: 56636 - DNA, 20 bp, Artificial Sequence
  sgRNA
  Slc47a1_15
gtacctgtggtggtatcctg

SEQ ID NO: 56637 - DNA, 20 bp, Artificial Sequence
  sgRNA
  Slc47a1_16
tgtggctgccaacgtccggg

SEQ ID NO: 56638 - DNA, 20 bp, Artificial Sequence
  sgRNA
  Slc47a1_17
cgtaggggttatcctgcaaa

SEQ ID NO: 56639 - DNA, 20 bp, Artificial Sequence
  sgRNA
  Slc47a1_18
gagaggactcctgctcctag

SEQ ID NO: 56640 - DNA, 20 bp, Artificial Sequence
  sgRNA
  Slc47a1_19
ccgtcatcataatttctcca

SEQ ID NO: 56641 - DNA, 20 bp, Artificial Sequence
  sgRNA
  Slc47a1_20
gactatcaaggaaatagctg

SEQ ID NO: 56642 - DNA, 20 bp, Artificial Sequence
  sgRNA
  Slc4a1_1
ctccatggcgcataaccgag

SEQ ID NO: 56643 - DNA, 20 bp, Artificial Sequence
  sgRNA
  Slc4a1_2
aataacctggagtatatcgt

SEQ ID NO: 56644 - DNA, 20 bp, Artificial Sequence
  sgRNA
  Slc4a1_3
tctacaacagacttgaacgg

SEQ ID NO: 56645 - DNA, 20 bp, Artificial Sequence
  sgRNA
  Slc4a1_4
cttacccactagcaccagtg

SEQ ID NO: 56646 - DNA, 20 bp, Artificial Sequence
  sgRNA
  Slc4a1_5
tctagactgcttcatctacg

SEQ ID NO: 56647 - DNA, 20 bp, Artificial Sequence
  sgRNA
  Slc4a1_6
ggatctccagcacttcctcg

SEQ ID NO: 56648 - DNA, 20 bp, Artificial Sequence
  sgRNA
  Slc4a1_7
atcgggagatgtattggacg

SEQ ID NO: 56649 - DNA, 20 bp, Artificial Sequence
  sgRNA
  Slc4a1_8
gccagaagccgatccacgcg

SEQ ID NO: 56650 - DNA, 20 bp, Artificial Sequence
  sgRNA
  Slc4a1_9
aaagacccggaacttgatgg

SEQ ID NO: 56651 - DNA, 20 bp, Artificial Sequence
  sgRNA
  Slc4a1_10
ggtcctgcatctcggtcaca

SEQ ID NO: 56652 - DNA, 20 bp, Artificial Sequence
  sgRNA
  Slc4a1_11
gtgattggccaccccagcca

SEQ ID NO: 56653 - DNA, 20 bp, Artificial Sequence
  sgRNA
  Slc4a1_12
gctggaggaaaaccttcgag

SEQ ID NO: 56654 - DNA, 20 bp, Artificial Sequence
  sgRNA
  Slc4a1_13
ggtagtaaggataacggcgc

SEQ ID NO: 56655 - DNA, 20 bp, Artificial Sequence
  sgRNA
  Slc4a1_14
gcttctccagaaaattagcc

SEQ ID NO: 56656 - DNA, 20 bp, Artificial Sequence
  sgRNA
  Slc4a1_15
agtatatcgtgggccgcgcg

SEQ ID NO: 56657 - DNA, 20 bp, Artificial Sequence
  sgRNA
  Slc4a1_16
aagtgtccaactcctccgcc

SEQ ID NO: 56658 - DNA, 20 bp, Artificial Sequence
  sgRNA
  Slc4a1_17
ccaatgccctcacagtcatg

SEQ ID NO: 56659 - DNA, 20 bp, Artificial Sequence
  sgRNA
  Slc4a1_18
gattccctaggtcctcagca

SEQ ID NO: 56660 - DNA, 20 bp, Artificial Sequence
  sgRNA
  Slc4a1_19
gaaaccacactggtgctagt

SEQ ID NO: 56661 - DNA, 20 bp, Artificial Sequence
  sgRNA
  Slc4a1_20
tgacaaagggcacatccggg

SEQ ID NO: 56662 - DNA, 20 bp, Artificial Sequence
  sgRNA
  Slc4a10_1
agagaacatctggcacgtag

SEQ ID NO: 56663 - DNA, 20 bp, Artificial Sequence
  sgRNA
  Slc4a10_2
cacgatgcctgtgacgacga

SEQ ID NO: 56664 - DNA, 20 bp, Artificial Sequence
  sgRNA
  Slc4a10_3
tgagatttgctggcgtgaag

SEQ ID NO: 56665 - DNA, 20 bp, Artificial Sequence
  sgRNA
  Slc4a10_4
ttcctgataccaagtcattg

SEQ ID NO: 56666 - DNA, 20 bp, Artificial Sequence
  sgRNA
  Slc4a10_5
gttcccccagattatgtcag

SEQ ID NO: 56667 - DNA, 20 bp, Artificial Sequence
  sgRNA
  Slc4a10_6
gaagagatggactttccgga

SEQ ID NO: 56668 - DNA, 20 bp, Artificial Sequence
  sgRNA
  Slc4a10_7
tttgaagcttcagcacccgg

SEQ ID NO: 56669 - DNA, 20 bp, Artificial Sequence
  sgRNA
  Slc4a10_8
aagccagctgagttcccgtt

SEQ ID NO: 56670 - DNA, 20 bp, Artificial Sequence
  sgRNA
  Slc4a10_9
tgttccacctctatccacaa

SEQ ID NO: 56671 - DNA, 20 bp, Artificial Sequence
  sgRNA
  Slc4a10_10
gtactgttgaccctttccca

SEQ ID NO: 56672 - DNA, 20 bp, Artificial Sequence
  sgRNA
  Slc4a10_11
agtgcaatcgaatcactctt

SEQ ID NO: 56673 - DNA, 20 bp, Artificial Sequence
  sgRNA
  Slc4a10_12
tcacctggatctgttaatgg

SEQ ID NO: 56674 - DNA, 20 bp, Artificial Sequence
  sgRNA
  Slc4a10_13
ggtccgctgtgtcctccatg

SEQ ID NO: 56675 - DNA, 20 bp, Artificial Sequence
  sgRNA
  Slc4a10_14
gcagctatgattgtccacca

SEQ ID NO: 56676 - DNA, 20 bp, Artificial Sequence
  sgRNA
  Slc4a10_15
caatcgatctgccaatctcg

SEQ ID NO: 56677 - DNA, 20 bp, Artificial Sequence
  sgRNA
  Slc4a10_16
tggtcataagcacagaaaga

SEQ ID NO: 56678 - DNA, 20 bp, Artificial Sequence
  sgRNA
  Slc4a10_17
aaggtgtaacaaaccagcca

SEQ ID NO: 56679 - DNA, 20 bp, Artificial Sequence
  sgRNA
  Slc4a10_18
agaaacactccgtataacac

SEQ ID NO: 56680 - DNA, 20 bp, Artificial Sequence
  sgRNA
  Slc4a10_19
gaatgaagatgttcgccaca

SEQ ID NO: 56681 - DNA, 20 bp, Artificial Sequence
  sgRNA
  Slc4a10_20
tcagcaaaagatcggacaat

SEQ ID NO: 56682 - DNA, 20 bp, Artificial Sequence
  sgRNA
  Slc4a4_1
agcctgctgtaggcgaacaa

SEQ ID NO: 56683 - DNA, 20 bp, Artificial Sequence
  sgRNA
  Slc4a4_2
gcctccaaaagtgatggcgt

SEQ ID NO: 56684 - DNA, 20 bp, Artificial Sequence
  sgRNA
  Slc4a4_3
actttgaagtcagagttgat

SEQ ID NO: 56685 - DNA, 20 bp, Artificial Sequence
  sgRNA
  Slc4a4_4
agagaatgttcagatgaatg

SEQ ID NO: 56686 - DNA, 20 bp, Artificial Sequence
  sgRNA
  Slc4a4_5
aagccaacaagtcctaacag

SEQ ID NO: 56687 - DNA, 20 bp, Artificial Sequence
  sgRNA
  Slc4a4_6
gatgaatcggatgcgttctg

SEQ ID NO: 56688 - DNA, 20 bp, Artificial Sequence
  sgRNA
  Slc4a4_7
aatagatgccctagtcggcg

SEQ ID NO: 56689 - DNA, 20 bp, Artificial Sequence
  sgRNA
  Slc4a4_8
acagtagcagccacatacca

SEQ ID NO: 56690 - DNA, 20 bp, Artificial Sequence
  sgRNA
  Slc4a4_9
gtaggcctgtctcgatctgg

SEQ ID NO: 56691 - DNA, 20 bp, Artificial Sequence
  sgRNA
  Slc4a4_10
gccagtcagaataaacacaa

SEQ ID NO: 56692 - DNA, 20 bp, Artificial Sequence
  sgRNA
  Slc4a4_11
ggatggtgactagcaaagcc

SEQ ID NO: 56693 - DNA, 20 bp, Artificial Sequence
  sgRNA
  Slc4a4_12
ggtttgttatcacttaggaa

SEQ ID NO: 56694 - DNA, 20 bp, Artificial Sequence
  sgRNA
  Slc4a4_13
agactgtctccagtgcaagt

SEQ ID NO: 56695 - DNA, 20 bp, Artificial Sequence
  sgRNA
  Slc4a4_14
gtggcgttcgaggaatgttg

SEQ ID NO: 56696 - DNA, 20 bp, Artificial Sequence
  sgRNA
  Slc4a4_15
taagcggttgacccgcaaaa

SEQ ID NO: 56697 - DNA, 20 bp, Artificial Sequence
  sgRNA
  Slc4a4_16
attcctttccttgagtcgct

SEQ ID NO: 56698 - DNA, 20 bp, Artificial Sequence
  sgRNA
  Slc4a4_17
gccaagtcctaccatgagat

SEQ ID NO: 56699 - DNA, 20 bp, Artificial Sequence
  sgRNA
  Slc4a4_18
gaggctctattcggattgtg

SEQ ID NO: 56700 - DNA, 20 bp, Artificial Sequence
  sgRNA
  Slc4a4_19
ggaggatgtcagattcctgt

SEQ ID NO: 56701 - DNA, 20 bp, Artificial Sequence
  sgRNA
  Slc4a4_20
ccgaagctccactttcctca

SEQ ID NO: 56702 - DNA, 20 bp, Artificial Sequence
  sgRNA
  Slc4a5_1
agctatgcacgaaatcgggg

SEQ ID NO: 56703 - DNA, 20 bp, Artificial Sequence
  sgRNA
  Slc4a5_2
tggggctgaggcattgaccg

SEQ ID NO: 56704 - DNA, 20 bp, Artificial Sequence
  sgRNA
  Slc4a5_3
ttaccttggtgggaaaatag

SEQ ID NO: 56705 - DNA, 20 bp, Artificial Sequence
  sgRNA
  Slc4a5_4
cacctcgcccacgagcacgt

SEQ ID NO: 56706 - DNA, 20 bp, Artificial Sequence
  sgRNA
  Slc4a5_5
tcaccgcagtcattgtcaac

SEQ ID NO: 56707 - DNA, 20 bp, Artificial Sequence
  sgRNA
  Slc4a5_6
tcgcgttggtaatacagccg

SEQ ID NO: 56708 - DNA, 20 bp, Artificial Sequence
  sgRNA
  Slc4a5_7
ctacccagaacaggtccaga

SEQ ID NO: 56709 - DNA, 20 bp, Artificial Sequence
  sgRNA
  Slc4a5_8
cgacttcccgatgtctgcaa

SEQ ID NO: 56710 - DNA, 20 bp, Artificial Sequence
  sgRNA
  Slc4a5_9
gtaccctgccagcatcctgc

SEQ ID NO: 56711 - DNA, 20 bp, Artificial Sequence
  sgRNA
  Slc4a5_10
cagatgggataccttccatg

SEQ ID NO: 56712 - DNA, 20 bp, Artificial Sequence
  sgRNA
  Slc4a5_11
gggaggccacacccatgtag

SEQ ID NO: 56713 - DNA, 20 bp, Artificial Sequence
  sgRNA
  Slc4a5_12
gtagcactgtccctgtctgc

SEQ ID NO: 56714 - DNA, 20 bp, Artificial Sequence
  sgRNA
  Slc4a5_13
ctgagtgaagaccaatccag

SEQ ID NO: 56715 - DNA, 20 bp, Artificial Sequence
  sgRNA
  Slc4a5_14
agacggagaccagtgccccg

SEQ ID NO: 56716 - DNA, 20 bp, Artificial Sequence
  sgRNA
  Slc4a5_15
gagctcaaagagactgtgca

SEQ ID NO: 56717 - DNA, 20 bp, Artificial Sequence
  sgRNA
  Slc4a5_16
cgatgtctgcaagggaacgg

SEQ ID NO: 56718 - DNA, 20 bp, Artificial Sequence
  sgRNA
  Slc4a5_17
gcactccttcttgctcagca

SEQ ID NO: 56719 - DNA, 20 bp, Artificial Sequence
  sgRNA
  Slc4a5_18
aatggagaagtcagccacca

SEQ ID NO: 56720 - DNA, 20 bp, Artificial Sequence
  sgRNA
  Slc4a5_19
caaatactatcccattaaca

SEQ ID NO: 56721 - DNA, 20 bp, Artificial Sequence
  sgRNA
  Slc4a5_20
tgttggtgtttggtgccagt

SEQ ID NO: 56722 - DNA, 20 bp, Artificial Sequence
  sgRNA
  Slc4a7_1
tcaggaacataaggtccatg

SEQ ID NO: 56723 - DNA, 20 bp, Artificial Sequence
  sgRNA
  Slc4a7_2
tctgcaaaggatcgaaccag

SEQ ID NO: 56724 - DNA, 20 bp, Artificial Sequence
  sgRNA
  Slc4a7_3
acagtataggaaaagaatcg

SEQ ID NO: 56725 - DNA, 20 bp, Artificial Sequence
  sgRNA
  Slc4a7_4
gcagatccattaggaaacac

SEQ ID NO: 56726 - DNA, 20 bp, Artificial Sequence
  sgRNA
  Slc4a7_5
aggccagacgacttaagtcg

SEQ ID NO: 56727 - DNA, 20 bp, Artificial Sequence
  sgRNA
  Slc4a7_6
gctctatcatgggcttgccg

SEQ ID NO: 56728 - DNA, 20 bp, Artificial Sequence
  sgRNA
  Slc4a7_7
catcgtcgtcttcagtcccg

SEQ ID NO: 56729 - DNA, 20 bp, Artificial Sequence
  sgRNA
  Slc4a7_8
gaacacgtgcaccttccaca

SEQ ID NO: 56730 - DNA, 20 bp, Artificial Sequence
  sgRNA
  Slc4a7_9
tgttcgcaaagaatggcggg

SEQ ID NO: 56731 - DNA, 20 bp, Artificial Sequence
  sgRNA
  Slc4a7_10
ggcaacctctaacaatactg

SEQ ID NO: 56732 - DNA, 20 bp, Artificial Sequence
  sgRNA
  Slc4a7_11
gagacggagaagagtacgag

SEQ ID NO: 56733 - DNA, 20 bp, Artificial Sequence
  sgRNA
  Slc4a7_12
gtgcacctcccattcgaaag

SEQ ID NO: 56734 - DNA, 20 bp, Artificial Sequence
  sgRNA
  Slc4a7_13
gaaggatcccactctcctgg

SEQ ID NO: 56735 - DNA, 20 bp, Artificial Sequence
  sgRNA
  Slc4a7_14
aggagactccctctttcgaa

SEQ ID NO: 56736 - DNA, 20 bp, Artificial Sequence
  sgRNA
  Slc4a7_15
agatgagaccgctactcacg

SEQ ID NO: 56737 - DNA, 20 bp, Artificial Sequence
  sgRNA
  Slc4a7_16
actgtcgcagccacaaacca

SEQ ID NO: 56738 - DNA, 20 bp, Artificial Sequence
  sgRNA
  Slc4a7_17
ttctgggaattcgtgaacag

SEQ ID NO: 56739 - DNA, 20 bp, Artificial Sequence
  sgRNA
  Slc4a7_18
gacctgttcgcaaagaatgg

SEQ ID NO: 56740 - DNA, 20 bp, Artificial Sequence
  sgRNA
  Slc4a7_19
ggaggccagacgacttaagt

SEQ ID NO: 56741 - DNA, 20 bp, Artificial Sequence
  sgRNA
  Slc4a7_20
gactccctctttcgaatggg

SEQ ID NO: 56742 - DNA, 20 bp, Artificial Sequence
  sgRNA
  Slc4a8_1
tcatgaaaaaaattcccacg

SEQ ID NO: 56743 - DNA, 20 bp, Artificial Sequence
  sgRNA
  Slc4a8_2
aacgactcaatcgcactctg

SEQ ID NO: 56744 - DNA, 20 bp, Artificial Sequence
  sgRNA
  Slc4a8_3
acagcgtgagggttaaagtg

SEQ ID NO: 56745 - DNA, 20 bp, Artificial Sequence
  sgRNA
  Slc4a8_4
ccttccaatactgtaaggtg

SEQ ID NO: 56746 - DNA, 20 bp, Artificial Sequence
  sgRNA
  Slc4a8_5
gccagagagcagcacagccg

SEQ ID NO: 56747 - DNA, 20 bp, Artificial Sequence
  sgRNA
  Slc4a8_6
gcgggtaatgtagcagacga

SEQ ID NO: 56748 - DNA, 20 bp, Artificial Sequence
  sgRNA
  Slc4a8_7
gcggctatcacagtccacca

SEQ ID NO: 56749 - DNA, 20 bp, Artificial Sequence
  sgRNA
  Slc4a8_8
tgatagctgaggacgccgtc

SEQ ID NO: 56750 - DNA, 20 bp, Artificial Sequence
  sgRNA
  Slc4a8_9
gaactgaacacgctgagacg

SEQ ID NO: 56751 - DNA, 20 bp, Artificial Sequence
  sgRNA
  Slc4a8_10
catcgtccgctccttcgctg

SEQ ID NO: 56752 - DNA, 20 bp, Artificial Sequence
  sgRNA
  Slc4a8_11
gatgggtcccactcccctgg

SEQ ID NO: 56753 - DNA, 20 bp, Artificial Sequence
  sgRNA
  Slc4a8_12
tgtttggagcgtccatgacg

SEQ ID NO: 56754 - DNA, 20 bp, Artificial Sequence
  sgRNA
  Slc4a8_13
ggtaatggacaggacggtcg

SEQ ID NO: 56755 - DNA, 20 bp, Artificial Sequence
  sgRNA
  Slc4a8_14
tcaccgctgtcatcattaac

SEQ ID NO: 56756 - DNA, 20 bp, Artificial Sequence
  sgRNA
  Slc4a8_15
gcgctggagcaagccttacg

SEQ ID NO: 56757 - DNA, 20 bp, Artificial Sequence
  sgRNA
  Slc4a8_16
actcgtcaatccctgccagg

SEQ ID NO: 56758 - DNA, 20 bp, Artificial Sequence
  sgRNA
  Slc4a8_17
gtagggtccgtggtgaccgc

SEQ ID NO: 56759 - DNA, 20 bp, Artificial Sequence
  sgRNA
  Slc4a8_18
atgtggcaaacgtttccgtt

SEQ ID NO: 56760 - DNA, 20 bp, Artificial Sequence
  sgRNA
  Slc4a8_19
caggtttgcccagttcactt

SEQ ID NO: 56761 - DNA, 20 bp, Artificial Sequence
  sgRNA
  Slc4a8_20
cttatgatcttcgtgctgat

SEQ ID NO: 56762 - DNA, 20 bp, Artificial Sequence
  sgRNA
  Slc51a_1
cactgaaggacaccccgatg

SEQ ID NO: 56763 - DNA, 20 bp, Artificial Sequence
  sgRNA
  Slc51a_2
tggtgagggctatgtccact

SEQ ID NO: 56764 - DNA, 20 bp, Artificial Sequence
  sgRNA
  Slc51a_3
tctacaagtgtgagggcgcg

SEQ ID NO: 56765 - DNA, 20 bp, Artificial Sequence
  sgRNA
  Slc51a_4
tcagagtcctcttcttgatg

SEQ ID NO: 56766 - DNA, 20 bp, Artificial Sequence
  sgRNA
  Slc51a_5
gccaagatggagaaaatggc

SEQ ID NO: 56767 - DNA, 20 bp, Artificial Sequence
  sgRNA
  Slc51a_6
tctccatcttggctaacagt

SEQ ID NO: 56768 - DNA, 20 bp, Artificial Sequence
  sgRNA
  Slc51a_7
tgtcagcactgtcatcagga

SEQ ID NO: 56769 - DNA, 20 bp, Artificial Sequence
  sgRNA
  Slc51a_8
ttgacggaaaaggatggcca

SEQ ID NO: 56770 - DNA, 20 bp, Artificial Sequence
  sgRNA
  Slc51a_9
ctatcgaaggaaagacgaca

SEQ ID NO: 56771 - DNA, 20 bp, Artificial Sequence
  sgRNA
  Slc51a_10
ggccatttctacaagtgtga

SEQ ID NO: 56772 - DNA, 20 bp, Artificial Sequence
  sgRNA
  Slc51a_11
gctcagcgttatcttgaaga

SEQ ID NO: 56773 - DNA, 20 bp, Artificial Sequence
  sgRNA
  Slc51a_12
ttatcttgaagaaggcgtac

SEQ ID NO: 56774 - DNA, 20 bp, Artificial Sequence
  sgRNA
  Slc51a_13
acccgtgtgcaccctcatcg

SEQ ID NO: 56775 - DNA, 20 bp, Artificial Sequence
  sgRNA
  Slc51a_14
cctgggtcatagatgccgtc

SEQ ID NO: 56776 - DNA, 20 bp, Artificial Sequence
  sgRNA
  Slc51a_15
cctgacggcatctatgaccc

SEQ ID NO: 56777 - DNA, 20 bp, Artificial Sequence
  sgRNA
  Slc51a_16
ttacctgctgatgatggtca

SEQ ID NO: 56778 - DNA, 20 bp, Artificial Sequence
  sgRNA
  Slc51a_17
cctgctgatgatggtcatgg

SEQ ID NO: 56779 - DNA, 20 bp, Artificial Sequence
  sgRNA
  Slc51a_18
cagggaccagagggccagaa

SEQ ID NO: 56780 - DNA, 20 bp, Artificial Sequence
  sgRNA
  Slc51a_19
ccaccatgaccatcatcagc

SEQ ID NO: 56781 - DNA, 20 bp, Artificial Sequence
  sgRNA
  Slc51a_20
catctgggtgaacagaacat

SEQ ID NO: 56782 - DNA, 20 bp, Artificial Sequence
  sgRNA
  Slc51b_1
cagcagttcctggggcacct

SEQ ID NO: 56783 - DNA, 20 bp, Artificial Sequence
  sgRNA
  Slc51b_2
agcatcctggcaaacaggtg

SEQ ID NO: 56784 - DNA, 20 bp, Artificial Sequence
  sgRNA
  Slc51b_3
acatgcttgtcatgaccacc

SEQ ID NO: 56785 - DNA, 20 bp, Artificial Sequence
  sgRNA
  Slc51b_4
accaggatggaataattcca

SEQ ID NO: 56786 - DNA, 20 bp, Artificial Sequence
  sgRNA
  Slc51b_5
tttcaactcaggttcccccg

SEQ ID NO: 56787 - DNA, 20 bp, Artificial Sequence
  sgRNA
  Slc51b_6
ctttcaactcaggttccccc

SEQ ID NO: 56788 - DNA, 20 bp, Artificial Sequence
  sgRNA
  Slc51b_7
tgtctttctgccagacccac

SEQ ID NO: 56789 - DNA, 20 bp, Artificial Sequence
  sgRNA
  Slc51b_8
gaaagctgcagccaatgccg

SEQ ID NO: 56790 - DNA, 20 bp, Artificial Sequence
  sgRNA
  Slc51b_9
agagaaaccagacttggccc

SEQ ID NO: 56791 - DNA, 20 bp, Artificial Sequence
  sgRNA
  Slc51b_10
gatctcagagaaaccagact

SEQ ID NO: 56792 - DNA, 20 bp, Artificial Sequence
  sgRNA
  Slc51b_11
cctggtcctggcagtcctgg

SEQ ID NO: 56793 - DNA, 20 bp, Artificial Sequence
  sgRNA
  Slc51b_12
gaaaccagacttggccccgg

SEQ ID NO: 56794 - DNA, 20 bp, Artificial Sequence
  sgRNA
  Slc51b_13
aatgaaagagaacaacagcc

SEQ ID NO: 56795 - DNA, 20 bp, Artificial Sequence
  sgRNA
  Slc51b_14
atttcttccagcagttcctg

SEQ ID NO: 56796 - DNA, 20 bp, Artificial Sequence
  sgRNA
  Slc51b_15
atgtctctcttaggaagacc

SEQ ID NO: 56797 - DNA, 20 bp, Artificial Sequence
  sgRNA
  Slc51b_16
agaaaccagacttggccccg

SEQ ID NO: 56798 - DNA, 20 bp, Artificial Sequence
  sgRNA
  Slc51b_17
ccaggatgctccttctcagg

SEQ ID NO: 56799 - DNA, 20 bp, Artificial Sequence
  sgRNA
  Slc51b_18
tctttcaactcaggttcccc

SEQ ID NO: 56800 - DNA, 20 bp, Artificial Sequence
  sgRNA
  Slc51b_19
ttatggagtcatcaagatgc

SEQ ID NO: 56801 - DNA, 20 bp, Artificial Sequence
  sgRNA
  Slc51b_20
tcatgaccaccaggactgcc

SEQ ID NO: 56802 - DNA, 20 bp, Artificial Sequence
  sgRNA
  Slc52a2_1
tgttgtgggttcagatgtcg

SEQ ID NO: 56803 - DNA, 20 bp, Artificial Sequence
  sgRNA
  Slc52a2_2
atgggagacacctcgatcgg

SEQ ID NO: 56804 - DNA, 20 bp, Artificial Sequence
  sgRNA
  Slc52a2_3
ggcctctctgtggaaccacg

SEQ ID NO: 56805 - DNA, 20 bp, Artificial Sequence
  sgRNA
  Slc52a2_4
aagaccgtaaaaaggggggt

SEQ ID NO: 56806 - DNA, 20 bp, Artificial Sequence
  sgRNA
  Slc52a2_5
atctaccgagtatttcgcag

SEQ ID NO: 56807 - DNA, 20 bp, Artificial Sequence
  sgRNA
  Slc52a2_6
cgagcaagtccccatccgag

SEQ ID NO: 56808 - DNA, 20 bp, Artificial Sequence
  sgRNA
  Slc52a2_7
ttaatgggagacacctcgat

SEQ ID NO: 56809 - DNA, 20 bp, Artificial Sequence
  sgRNA
  Slc52a2_8
gtggtgaaagagctcccgga

SEQ ID NO: 56810 - DNA, 20 bp, Artificial Sequence
  sgRNA
  Slc52a2_9
gggatggcagtagtaacagg

SEQ ID NO: 56811 - DNA, 20 bp, Artificial Sequence
  sgRNA
  Slc52a2_10
cacgttctcgtatatcaagg

SEQ ID NO: 56812 - DNA, 20 bp, Artificial Sequence
  sgRNA
  Slc52a2_11
gcagatgggtcagcaccagt

SEQ ID NO: 56813 - DNA, 20 bp, Artificial Sequence
  sgRNA
  Slc52a2_12
ccgacatctgaacccacaac

SEQ ID NO: 56814 - DNA, 20 bp, Artificial Sequence
  sgRNA
  Slc52a2_13
tggtaggccaggcgcccata

SEQ ID NO: 56815 - DNA, 20 bp, Artificial Sequence
  sgRNA
  Slc52a2_14
ctgaacccacaacaggtaca

SEQ ID NO: 56816 - DNA, 20 bp, Artificial Sequence
  sgRNA
  Slc52a2_15
agtacggctttcctgccact

SEQ ID NO: 56817 - DNA, 20 bp, Artificial Sequence
  sgRNA
  Slc52a2_16
atcagttccatgttacacag

SEQ ID NO: 56818 - DNA, 20 bp, Artificial Sequence
  sgRNA
  Slc52a2_17
ccagcgccacaagcacagag

SEQ ID NO: 56819 - DNA, 20 bp, Artificial Sequence
  sgRNA
  Slc52a2_18
agtggtgaaagagctcccgg

SEQ ID NO: 56820 - DNA, 20 bp, Artificial Sequence
  sgRNA
  Slc52a2_19
ccaggagcccatgccgaaaa

SEQ ID NO: 56821 - DNA, 20 bp, Artificial Sequence
  sgRNA
  Slc52a2_20
ttaaggctgccagtgtcatc

SEQ ID NO: 56822 - DNA, 20 bp, Artificial Sequence
  sgRNA
  Slc52a3_1
gtgacctcctggatacaggg

SEQ ID NO: 56823 - DNA, 20 bp, Artificial Sequence
  sgRNA
  Slc52a3_2
tgtctccgtgacattgacac

SEQ ID NO: 56824 - DNA, 20 bp, Artificial Sequence
  sgRNA
  Slc52a3_3
gctggtgactgagttgcccg

SEQ ID NO: 56825 - DNA, 20 bp, Artificial Sequence
  sgRNA
  Slc52a3_4
gggtcggaagcggtgcatca

SEQ ID NO: 56826 - DNA, 20 bp, Artificial Sequence
  sgRNA
  Slc52a3_5
atggagccttgccgtcccca

SEQ ID NO: 56827 - DNA, 20 bp, Artificial Sequence
  sgRNA
  Slc52a3_6
gcaggagtaggtctgcacgg

SEQ ID NO: 56828 - DNA, 20 bp, Artificial Sequence
  sgRNA
  Slc52a3_7
gataccggagccttggacaa

SEQ ID NO: 56829 - DNA, 20 bp, Artificial Sequence
  sgRNA
  Slc52a3_8
tgccaaagacgcagaccagt

SEQ ID NO: 56830 - DNA, 20 bp, Artificial Sequence
  sgRNA
  Slc52a3_9
ctgtccaccctgtatccagg

SEQ ID NO: 56831 - DNA, 20 bp, Artificial Sequence
  sgRNA
  Slc52a3_10
accaccttcttcataggcga

SEQ ID NO: 56832 - DNA, 20 bp, Artificial Sequence
  sgRNA
  Slc52a3_11
ggcaactcagtcaccagcag

SEQ ID NO: 56833 - DNA, 20 bp, Artificial Sequence
  sgRNA
  Slc52a3_12
gcaccaggagagccgctacc

SEQ ID NO: 56834 - DNA, 20 bp, Artificial Sequence
  sgRNA
  Slc52a3_13
aaggtggtaagatagtacgt

SEQ ID NO: 56835 - DNA, 20 bp, Artificial Sequence
  sgRNA
  Slc52a3_14
gccttggacaagggccacca

SEQ ID NO: 56836 - DNA, 20 bp, Artificial Sequence
  sgRNA
  Slc52a3_15
atagtgttcaaggtggtccc

SEQ ID NO: 56837 - DNA, 20 bp, Artificial Sequence
  sgRNA
  Slc52a3_16
ccaccttcttcataggcgag

SEQ ID NO: 56838 - DNA, 20 bp, Artificial Sequence
  sgRNA
  Slc52a3_17
tggggcctacaatatggcca

SEQ ID NO: 56839 - DNA, 20 bp, Artificial Sequence
  sgRNA
  Slc52a3_18
gctggccttcatctactccg

SEQ ID NO: 56840 - DNA, 20 bp, Artificial Sequence
  sgRNA
  Slc52a3_19
catattgtaggccccaaagc

SEQ ID NO: 56841 - DNA, 20 bp, Artificial Sequence
  sgRNA
  Slc52a3_20
agctatgtcaaggtgatgct

SEQ ID NO: 56842 - DNA, 20 bp, Artificial Sequence
  sgRNA
  Slc5a1_1
aggaagaatgctacacaccg

SEQ ID NO: 56843 - DNA, 20 bp, Artificial Sequence
  sgRNA
  Slc5a1_2
gagacatgttcttggccgag

SEQ ID NO: 56844 - DNA, 20 bp, Artificial Sequence
  sgRNA
  Slc5a1_3
catcgcctaccccacgctcg

SEQ ID NO: 56845 - DNA, 20 bp, Artificial Sequence
  sgRNA
  Slc5a1_4
ccggccaccacaccatactt

SEQ ID NO: 56846 - DNA, 20 bp, Artificial Sequence
  sgRNA
  Slc5a1_5
ccattactggagacatgccg

SEQ ID NO: 56847 - DNA, 20 bp, Artificial Sequence
  sgRNA
  Slc5a1_6
ggaagaatgctacacaccga

SEQ ID NO: 56848 - DNA, 20 bp, Artificial Sequence
  sgRNA
  Slc5a1_7
tgcatcggtggcagtaaccg

SEQ ID NO: 56849 - DNA, 20 bp, Artificial Sequence
  sgRNA
  Slc5a1_8
cccgatttacatcaaggccg

SEQ ID NO: 56850 - DNA, 20 bp, Artificial Sequence
  sgRNA
  Slc5a1_9
catcggtggcagtaaccgcg

SEQ ID NO: 56851 - DNA, 20 bp, Artificial Sequence
  sgRNA
  Slc5a1_10
tgctgatgccaatcagcacg

SEQ ID NO: 56852 - DNA, 20 bp, Artificial Sequence
  sgRNA
  Slc5a1_11
tagattgatgaatatagccc

SEQ ID NO: 56853 - DNA, 20 bp, Artificial Sequence
  sgRNA
  Slc5a1_12
tgtgtagcattcttccttgg

SEQ ID NO: 56854 - DNA, 20 bp, Artificial Sequence
  sgRNA
  Slc5a1_13
ctacgagcgcattcgcaatg

SEQ ID NO: 56855 - DNA, 20 bp, Artificial Sequence
  sgRNA
  Slc5a1_14
tgagttccaccacgagcgtg

SEQ ID NO: 56856 - DNA, 20 bp, Artificial Sequence
  sgRNA
  Slc5a1_15
catgagttccaccacgagcg

SEQ ID NO: 56857 - DNA, 20 bp, Artificial Sequence
  sgRNA
  Slc5a1_16
tttccgttagaaaccttagt

SEQ ID NO: 56858 - DNA, 20 bp, Artificial Sequence
  sgRNA
  Slc5a1_17
gcgatgttggtacagcccac

SEQ ID NO: 56859 - DNA, 20 bp, Artificial Sequence
  sgRNA
  Slc5a1_18
tgccaggaagaagcctccaa

SEQ ID NO: 56860 - DNA, 20 bp, Artificial Sequence
  sgRNA
  Slc5a1_19
tgcgtagactccaacacaaa

SEQ ID NO: 56861 - DNA, 20 bp, Artificial Sequence
  sgRNA
  Slc5a1_20
atccgtacaccagtaccaca

SEQ ID NO: 56862 - DNA, 20 bp, Artificial Sequence
  sgRNA
  Slc5a10_1
acaggacagataagtacgtg

SEQ ID NO: 56863 - DNA, 20 bp, Artificial Sequence
  sgRNA
  Slc5a10_2
caggctcgcagacactcgga

SEQ ID NO: 56864 - DNA, 20 bp, Artificial Sequence
  sgRNA
  Slc5a10_3
agccggccaatcctacgaag

SEQ ID NO: 56865 - DNA, 20 bp, Artificial Sequence
  sgRNA
  Slc5a10_4
ggttcttacccatatgccca

SEQ ID NO: 56866 - DNA, 20 bp, Artificial Sequence
  sgRNA
  Slc5a10_5
cgtgcggccaaatcgatacc

SEQ ID NO: 56867 - DNA, 20 bp, Artificial Sequence
  sgRNA
  Slc5a10_6
gcagtcagtgaccagctcgc

SEQ ID NO: 56868 - DNA, 20 bp, Artificial Sequence
  sgRNA
  Slc5a10_7
atatgcatggcgtctgctcg

SEQ ID NO: 56869 - DNA, 20 bp, Artificial Sequence
  sgRNA
  Slc5a10_8
ccaaaggtcatcccagtcca

SEQ ID NO: 56870 - DNA, 20 bp, Artificial Sequence
  sgRNA
  Slc5a10_9
tggcgttgacattacacacg

SEQ ID NO: 56871 - DNA, 20 bp, Artificial Sequence
  sgRNA
  Slc5a10_10
ggtggactctggctccaaac

SEQ ID NO: 56872 - DNA, 20 bp, Artificial Sequence
  sgRNA
  Slc5a10_11
agtgcaagtaatgtaggctg

SEQ ID NO: 56873 - DNA, 20 bp, Artificial Sequence
  sgRNA
  Slc5a10_12
tggaacatgggcatccccag

SEQ ID NO: 56874 - DNA, 20 bp, Artificial Sequence
  sgRNA
  Slc5a10_13
gtatcgatttggccgcacgg

SEQ ID NO: 56875 - DNA, 20 bp, Artificial Sequence
  sgRNA
  Slc5a10_14
tcactctttgcaagcagcga

SEQ ID NO: 56876 - DNA, 20 bp, Artificial Sequence
  sgRNA
  Slc5a10_15
tacctgaagatgcttcccat

SEQ ID NO: 56877 - DNA, 20 bp, Artificial Sequence
  sgRNA
  Slc5a10_16
ggcatctgtgtatatcacag

SEQ ID NO: 56878 - DNA, 20 bp, Artificial Sequence
  sgRNA
  Slc5a10_17
cttccacaggagacctcccg

SEQ ID NO: 56879 - DNA, 20 bp, Artificial Sequence
  sgRNA
  Slc5a10_18
ggtatcgatttggccgcacg

SEQ ID NO: 56880 - DNA, 20 bp, Artificial Sequence
  sgRNA
  Slc5a10_19
gcctggatcccggtcctgca

SEQ ID NO: 56881 - DNA, 20 bp, Artificial Sequence
  sgRNA
  Slc5a10_20
gtttggagccagagtccacc

SEQ ID NO: 56882 - DNA, 20 bp, Artificial Sequence
  sgRNA
  Slc5a11_1
cgatgccagaatatctaagg

SEQ ID NO: 56883 - DNA, 20 bp, Artificial Sequence
  sgRNA
  Slc5a11_2
gcgatgtctgaacagccaga

SEQ ID NO: 56884 - DNA, 20 bp, Artificial Sequence
  sgRNA
  Slc5a11_3
atgtggaaggcatcttctcg

SEQ ID NO: 56885 - DNA, 20 bp, Artificial Sequence
  sgRNA
  Slc5a11_4
cctgcacaatggggatccag

SEQ ID NO: 56886 - DNA, 20 bp, Artificial Sequence
  sgRNA
  Slc5a11_5
tcatcaggctggtcacaccg

SEQ ID NO: 56887 - DNA, 20 bp, Artificial Sequence
  sgRNA
  Slc5a11_6
gacgagtgaaccaagtcagg

SEQ ID NO: 56888 - DNA, 20 bp, Artificial Sequence
  sgRNA
  Slc5a11_7
tcttagccctggctagtaac

SEQ ID NO: 56889 - DNA, 20 bp, Artificial Sequence
  sgRNA
  Slc5a11_8
actttgtctacgcgcagcct

SEQ ID NO: 56890 - DNA, 20 bp, Artificial Sequence
  sgRNA
  Slc5a11_9
agctccctttcagatgcccg

SEQ ID NO: 56891 - DNA, 20 bp, Artificial Sequence
  sgRNA
  Slc5a11_10
tgtggaaccacatccggcca

SEQ ID NO: 56892 - DNA, 20 bp, Artificial Sequence
  sgRNA
  Slc5a11_11
gaggatggagaccagcacca

SEQ ID NO: 56893 - DNA, 20 bp, Artificial Sequence
  sgRNA
  Slc5a11_12
tttcttgaactgtctccagc

SEQ ID NO: 56894 - DNA, 20 bp, Artificial Sequence
  sgRNA
  Slc5a11_13
catctgatctcccctggcct

SEQ ID NO: 56895 - DNA, 20 bp, Artificial Sequence
  sgRNA
  Slc5a11_14
ataggagccttcatcctcat

SEQ ID NO: 56896 - DNA, 20 bp, Artificial Sequence
  sgRNA
  Slc5a11_15
tcacagccatcatgagccca

SEQ ID NO: 56897 - DNA, 20 bp, Artificial Sequence
  sgRNA
  Slc5a11_16
cgatgtctgaacagccagag

SEQ ID NO: 56898 - DNA, 20 bp, Artificial Sequence
  sgRNA
  Slc5a11_17
gcatcctgacatctgccaga

SEQ ID NO: 56899 - DNA, 20 bp, Artificial Sequence
  sgRNA
  Slc5a11_18
tcctccaaggaaactatgac

SEQ ID NO: 56900 - DNA, 20 bp, Artificial Sequence
  sgRNA
  Slc5a11_19
atctgtacctggccatagta

SEQ ID NO: 56901 - DNA, 20 bp, Artificial Sequence
  sgRNA
  Slc5a11_20
gaacaggtagagcacagcca

SEQ ID NO: 56902 - DNA, 20 bp, Artificial Sequence
  sgRNA
  Slc5a12_1
aggtactcagtttgtcggag

SEQ ID NO: 56903 - DNA, 20 bp, Artificial Sequence
  sgRNA
  Slc5a12_2
cattatctacatcgtacaga

SEQ ID NO: 56904 - DNA, 20 bp, Artificial Sequence
  sgRNA
  Slc5a12_3
tctcgggaattcttagtagg

SEQ ID NO: 56905 - DNA, 20 bp, Artificial Sequence
  sgRNA
  Slc5a12_4
atccaaggatcaaatcatgt

SEQ ID NO: 56906 - DNA, 20 bp, Artificial Sequence
  sgRNA
  Slc5a12_5
gacctgtcctagctgacaca

SEQ ID NO: 56907 - DNA, 20 bp, Artificial Sequence
  sgRNA
  Slc5a12_6
gtggcagtgcctggaaacaa

SEQ ID NO: 56908 - DNA, 20 bp, Artificial Sequence
  sgRNA
  Slc5a12_7
gctctaggaggacttcttac

SEQ ID NO: 56909 - DNA, 20 bp, Artificial Sequence
  sgRNA
  Slc5a12_8
gcatgaccgggaaacagagc

SEQ ID NO: 56910 - DNA, 20 bp, Artificial Sequence
  sgRNA
  Slc5a12_9
ctgtcagagacaaagctaca

SEQ ID NO: 56911 - DNA, 20 bp, Artificial Sequence
  sgRNA
  Slc5a12_10
cacagcactgaagtaaaggt

SEQ ID NO: 56912 - DNA, 20 bp, Artificial Sequence
  sgRNA
  Slc5a12_11
gtggacagatgcatttcaga

SEQ ID NO: 56913 - DNA, 20 bp, Artificial Sequence
  sgRNA
  Slc5a12_12
gctgtcagagacaaagctac

SEQ ID NO: 56914 - DNA, 20 bp, Artificial Sequence
  sgRNA
  Slc5a12_13
gttgaatctggcctacagaa

SEQ ID NO: 56915 - DNA, 20 bp, Artificial Sequence
  sgRNA
  Slc5a12_14
gcaagagatgcatctctgga

SEQ ID NO: 56916 - DNA, 20 bp, Artificial Sequence
  sgRNA
  Slc5a12_15
ttgatgtagatcctctaaga

SEQ ID NO: 56917 - DNA, 20 bp, Artificial Sequence
  sgRNA
  Slc5a12_16
cgtctgtacgatgtagataa

SEQ ID NO: 56918 - DNA, 20 bp, Artificial Sequence
  sgRNA
  Slc5a12_17
acacatgccatggatgctga

SEQ ID NO: 56919 - DNA, 20 bp, Artificial Sequence
  sgRNA
  Slc5a12_18
tcagcatccatggcatgtgt

SEQ ID NO: 56920 - DNA, 20 bp, Artificial Sequence
  sgRNA
  Slc5a12_19
ttgtcattctgggtggccat

SEQ ID NO: 56921 - DNA, 20 bp, Artificial Sequence
  sgRNA
  Slc5a12_20
agggtcacaatccttgaagt

SEQ ID NO: 56922 - DNA, 20 bp, Artificial Sequence
  sgRNA
  Slc5a2_1
atgatttatactgtgacagg

SEQ ID NO: 56923 - DNA, 20 bp, Artificial Sequence
  sgRNA
  Slc5a2_2
ctggcacaaaaagccatccg

SEQ ID NO: 56924 - DNA, 20 bp, Artificial Sequence
  sgRNA
  Slc5a2_3
ggtctcttcgacaaatacct

SEQ ID NO: 56925 - DNA, 20 bp, Artificial Sequence
  sgRNA
  Slc5a2_4
attggttctgaacatagact

SEQ ID NO: 56926 - DNA, 20 bp, Artificial Sequence
  sgRNA
  Slc5a2_5
ggttgactactcgtgcccag

SEQ ID NO: 56927 - DNA, 20 bp, Artificial Sequence
  sgRNA
  Slc5a2_6
gctctaacatcgcctaccca

SEQ ID NO: 56928 - DNA, 20 bp, Artificial Sequence
  sgRNA
  Slc5a2_7
cctgctcctgtgcagaacgg

SEQ ID NO: 56929 - DNA, 20 bp, Artificial Sequence
  sgRNA
  Slc5a2_8
gtacaaaaaaagcgagagca

SEQ ID NO: 56930 - DNA, 20 bp, Artificial Sequence
  sgRNA
  Slc5a2_9
atgagcttcaccacgagccg

SEQ ID NO: 56931 - DNA, 20 bp, Artificial Sequence
  sgRNA
  Slc5a2_10
aggtggcggcaaccaccagg

SEQ ID NO: 56932 - DNA, 20 bp, Artificial Sequence
  sgRNA
  Slc5a2_11
tgagcttcaccacgagccgt

SEQ ID NO: 56933 - DNA, 20 bp, Artificial Sequence
  sgRNA
  Slc5a2_12
gcagctccttatcacctgca

SEQ ID NO: 56934 - DNA, 20 bp, Artificial Sequence
  sgRNA
  Slc5a2_13
gccccagaggaacacagcca

SEQ ID NO: 56935 - DNA, 20 bp, Artificial Sequence
  sgRNA
  Slc5a2_14
gcgataaccagaatgtcagc

SEQ ID NO: 56936 - DNA, 20 bp, Artificial Sequence
  sgRNA
  Slc5a2_15
actgatgtcctccagccgcc

SEQ ID NO: 56937 - DNA, 20 bp, Artificial Sequence
  sgRNA
  Slc5a2_16
ttgactactcgtgcccagcg

SEQ ID NO: 56938 - DNA, 20 bp, Artificial Sequence
  sgRNA
  Slc5a2_17
ggagactgaaaaccaggcga

SEQ ID NO: 56939 - DNA, 20 bp, Artificial Sequence
  sgRNA
  Slc5a2_18
gagtcctccgcccactaccg

SEQ ID NO: 56940 - DNA, 20 bp, Artificial Sequence
  sgRNA
  Slc5a2_19
gggagcaatgacttcactga

SEQ ID NO: 56941 - DNA, 20 bp, Artificial Sequence
  sgRNA
  Slc5a2_20
ctgggtggtattcatcgtgg

SEQ ID NO: 56942 - DNA, 20 bp, Artificial Sequence
  sgRNA
  Slc5a3_1
cccctgaccggatgtaaatg

SEQ ID NO: 56943 - DNA, 20 bp, Artificial Sequence
  sgRNA
  Slc5a3_2
ctgaccaagtcatcgtacag

SEQ ID NO: 56944 - DNA, 20 bp, Artificial Sequence
  sgRNA
  Slc5a3_3
gaacactgcatgcaagtgtg

SEQ ID NO: 56945 - DNA, 20 bp, Artificial Sequence
  sgRNA
  Slc5a3_4
ctgtgtagatcactgcaaca

SEQ ID NO: 56946 - DNA, 20 bp, Artificial Sequence
  sgRNA
  Slc5a3_5
tcagccatactattcccaac

SEQ ID NO: 56947 - DNA, 20 bp, Artificial Sequence
  sgRNA
  Slc5a3_6
ggtacaactatgataaacat

SEQ ID NO: 56948 - DNA, 20 bp, Artificial Sequence
  sgRNA
  Slc5a3_7
agattatctgactcctcccg

SEQ ID NO: 56949 - DNA, 20 bp, Artificial Sequence
  sgRNA
  Slc5a3_8
ggttgtcatcagcatagcat

SEQ ID NO: 56950 - DNA, 20 bp, Artificial Sequence
  sgRNA
  Slc5a3_9
gataagtttgtacacatcga

SEQ ID NO: 56951 - DNA, 20 bp, Artificial Sequence
  sgRNA
  Slc5a3_10
ctgtcttcagacttcccgtt

SEQ ID NO: 56952 - DNA, 20 bp, Artificial Sequence
  sgRNA
  Slc5a3_11
agcacaccagtaccataccg

SEQ ID NO: 56953 - DNA, 20 bp, Artificial Sequence
  sgRNA
  Slc5a3_12
ccgagaagagggcaacccag

SEQ ID NO: 56954 - DNA, 20 bp, Artificial Sequence
  sgRNA
  Slc5a3_13
gctctgctgactgtcaccgg

SEQ ID NO: 56955 - DNA, 20 bp, Artificial Sequence
  sgRNA
  Slc5a3_14
tgaccaagtcatcgtacaga

SEQ ID NO: 56956 - DNA, 20 bp, Artificial Sequence
  sgRNA
  Slc5a3_15
ttatcaggttgatcacactc

SEQ ID NO: 56957 - DNA, 20 bp, Artificial Sequence
  sgRNA
  Slc5a3_16
catgagagctgcttgcccat

SEQ ID NO: 56958 - DNA, 20 bp, Artificial Sequence
  sgRNA
  Slc5a3_17
ccaaggtcatcaccaggcgt

SEQ ID NO: 56959 - DNA, 20 bp, Artificial Sequence
  sgRNA
  Slc5a3_18
gcatggtatatacccctgac

SEQ ID NO: 56960 - DNA, 20 bp, Artificial Sequence
  sgRNA
  Slc5a3_19
agtgtgatcaacctgataac

SEQ ID NO: 56961 - DNA, 20 bp, Artificial Sequence
  sgRNA
  Slc5a3_20
catgaccaggataaaataca

SEQ ID NO: 56962 - DNA, 20 bp, Artificial Sequence
  sgRNA
  Slc5a4a_1
ctgacttaccgaataccatg

SEQ ID NO: 56963 - DNA, 20 bp, Artificial Sequence
  sgRNA
  Slc5a4a_2
gtggtactggtgcataaacc

SEQ ID NO: 56964 - DNA, 20 bp, Artificial Sequence
  sgRNA
  Slc5a4a_3
ccccagccttgatgtaaatg

SEQ ID NO: 56965 - DNA, 20 bp, Artificial Sequence
  sgRNA
  Slc5a4a_4
tctgagtgtgtgaagcattg

SEQ ID NO: 56966 - DNA, 20 bp, Artificial Sequence
  sgRNA
  Slc5a4a_5
agaagcctccaacagtgctt

SEQ ID NO: 56967 - DNA, 20 bp, Artificial Sequence
  sgRNA
  Slc5a4a_6
tttgccagcaacatcggcag

SEQ ID NO: 56968 - DNA, 20 bp, Artificial Sequence
  sgRNA
  Slc5a4a_7
acgctgctacagccaagagg

SEQ ID NO: 56969 - DNA, 20 bp, Artificial Sequence
  sgRNA
  Slc5a4a_8
acagccatcttcacaatcac

SEQ ID NO: 56970 - DNA, 20 bp, Artificial Sequence
  sgRNA
  Slc5a4a_9
gagagagagctcctgatagc

SEQ ID NO: 56971 - DNA, 20 bp, Artificial Sequence
  sgRNA
  Slc5a4a_10
gtgctgaagctgatgcccat

SEQ ID NO: 56972 - DNA, 20 bp, Artificial Sequence
  sgRNA
  Slc5a4a_11
gttggaggcttctttctggc

SEQ ID NO: 56973 - DNA, 20 bp, Artificial Sequence
  sgRNA
  Slc5a4a_12
ttcatgaccgtccgccagaa

SEQ ID NO: 56974 - DNA, 20 bp, Artificial Sequence
  sgRNA
  Slc5a4a_13
ggctcttcggaacagtaagg

SEQ ID NO: 56975 - DNA, 20 bp, Artificial Sequence
  sgRNA
  Slc5a4a_14
atagtagaagtatctcaagg

SEQ ID NO: 56976 - DNA, 20 bp, Artificial Sequence
  sgRNA
  Slc5a4a_15
ggatgaggatggccaggtaa

SEQ ID NO: 56977 - DNA, 20 bp, Artificial Sequence
  sgRNA
  Slc5a4a_16
gtacaggtctatggtgaaga

SEQ ID NO: 56978 - DNA, 20 bp, Artificial Sequence
  sgRNA
  Slc5a4a_17
gtgtgtatattggttatcct

SEQ ID NO: 56979 - DNA, 20 bp, Artificial Sequence
  sgRNA
  Slc5a4a_18
gacggtgtctgtgtaaatca

SEQ ID NO: 56980 - DNA, 20 bp, Artificial Sequence
  sgRNA
  Slc5a4a_19
gtcttcttgagacatccacg

SEQ ID NO: 56981 - DNA, 20 bp, Artificial Sequence
  sgRNA
  Slc5a4a_20
aaaacgctgctacagccaag

SEQ ID NO: 56982 - DNA, 20 bp, Artificial Sequence
  sgRNA
  Slc5a4b_1
tcaatggtgagaagcaaccg

SEQ ID NO: 56983 - DNA, 20 bp, Artificial Sequence
  sgRNA
  Slc5a4b_2
gatgcaggcggccttcacgt

SEQ ID NO: 56984 - DNA, 20 bp, Artificial Sequence
  sgRNA
  Slc5a4b_3
aagaaccagcaccataagca

SEQ ID NO: 56985 - DNA, 20 bp, Artificial Sequence
  sgRNA
  Slc5a4b_4
acactcagaaggtacaacgc

SEQ ID NO: 56986 - DNA, 20 bp, Artificial Sequence
  sgRNA
  Slc5a4b_5
tgtccccctccactacagag

SEQ ID NO: 56987 - DNA, 20 bp, Artificial Sequence
  sgRNA
  Slc5a4b_6
gcagcattctgaatgcgcac

SEQ ID NO: 56988 - DNA, 20 bp, Artificial Sequence
  sgRNA
  Slc5a4b_7
ttcatgacggttctccacaa

SEQ ID NO: 56989 - DNA, 20 bp, Artificial Sequence
  sgRNA
  Slc5a4b_8
ctaatggtcggacttgtggt

SEQ ID NO: 56990 - DNA, 20 bp, Artificial Sequence
  sgRNA
  Slc5a4b_9
catcgtcatctacttcatag

SEQ ID NO: 56991 - DNA, 20 bp, Artificial Sequence
  sgRNA
  Slc5a4b_10
gagagctcatgatagccgga

SEQ ID NO: 56992 - DNA, 20 bp, Artificial Sequence
  sgRNA
  Slc5a4b_11
atacggaacaggcagctgcg

SEQ ID NO: 56993 - DNA, 20 bp, Artificial Sequence
  sgRNA
  Slc5a4b_12
gagagagagctcatgatagc

SEQ ID NO: 56994 - DNA, 20 bp, Artificial Sequence
  sgRNA
  Slc5a4b_13
gcttgctatcttcttcaaaa

SEQ ID NO: 56995 - DNA, 20 bp, Artificial Sequence
  sgRNA
  Slc5a4b_14
gcagcttcaggtaaccacac

SEQ ID NO: 56996 - DNA, 20 bp, Artificial Sequence
  sgRNA
  Slc5a4b_15
tctgtgacacctggaccagt

SEQ ID NO: 56997 - DNA, 20 bp, Artificial Sequence
  sgRNA
  Slc5a4b_16
agcatgaagactgcaccaag

SEQ ID NO: 56998 - DNA, 20 bp, Artificial Sequence
  sgRNA
  Slc5a4b_17
tgttccaaagactccagcat

SEQ ID NO: 56999 - DNA, 20 bp, Artificial Sequence
  sgRNA
  Slc5a4b_18
atgccctcttgagacagcca

SEQ ID NO: 57000 - DNA, 20 bp, Artificial Sequence
  sgRNA
  Slc5a4b_19
ggatgaagacagccaggtag

SEQ ID NO: 57001 - DNA, 20 bp, Artificial Sequence
  sgRNA
  Slc5a4b_20
ccaaatatcagtcccggcca

SEQ ID NO: 57002 - DNA, 20 bp, Artificial Sequence
  sgRNA
  Slc5a5_1
ctgcaccttgtacacgaccg

SEQ ID NO: 57003 - DNA, 20 bp, Artificial Sequence
  sgRNA
  Slc5a5_2
gctggccgctagcttcatgt

SEQ ID NO: 57004 - DNA, 20 bp, Artificial Sequence
  sgRNA
  Slc5a5_3
gtccaccagtatcaacgcta

SEQ ID NO: 57005 - DNA, 20 bp, Artificial Sequence
  sgRNA
  Slc5a5_4
gtacatgccattgctcgtgt

SEQ ID NO: 57006 - DNA, 20 bp, Artificial Sequence
  sgRNA
  Slc5a5_5
agaactgcgcttcagccgag

SEQ ID NO: 57007 - DNA, 20 bp, Artificial Sequence
  sgRNA
  Slc5a5_6
gagctgccaacacttccaga

SEQ ID NO: 57008 - DNA, 20 bp, Artificial Sequence
  sgRNA
  Slc5a5_7
ggtcccaccacagtaatccg

SEQ ID NO: 57009 - DNA, 20 bp, Artificial Sequence
  sgRNA
  Slc5a5_8
gcgagactgagcacgttcca

SEQ ID NO: 57010 - DNA, 20 bp, Artificial Sequence
  sgRNA
  Slc5a5_9
gcgttatgtggcctgtcaca

SEQ ID NO: 57011 - DNA, 20 bp, Artificial Sequence
  sgRNA
  Slc5a5_10
attggtgcatcccgcagccg

SEQ ID NO: 57012 - DNA, 20 bp, Artificial Sequence
  sgRNA
  Slc5a5_11
gcccccggtgaagaagtcgt

SEQ ID NO: 57013 - DNA, 20 bp, Artificial Sequence
  sgRNA
  Slc5a5_12
cgaacacgccgtagtcccag

SEQ ID NO: 57014 - DNA, 20 bp, Artificial Sequence
  sgRNA
  Slc5a5_13
gcatcgtgccccagatacag

SEQ ID NO: 57015 - DNA, 20 bp, Artificial Sequence
  sgRNA
  Slc5a5_14
gagatgaaaaccagcttccg

SEQ ID NO: 57016 - DNA, 20 bp, Artificial Sequence
  sgRNA
  Slc5a5_15
ccattcccggatcaacctga

SEQ ID NO: 57017 - DNA, 20 bp, Artificial Sequence
  sgRNA
  Slc5a5_16
cgccgacgacttcttcaccg

SEQ ID NO: 57018 - DNA, 20 bp, Artificial Sequence
  sgRNA
  Slc5a5_17
ttgccgatcttctaccgcct

SEQ ID NO: 57019 - DNA, 20 bp, Artificial Sequence
  sgRNA
  Slc5a5_18
gccgacgacttcttcaccgg

SEQ ID NO: 57020 - DNA, 20 bp, Artificial Sequence
  sgRNA
  Slc5a5_19
aaaatgtccaacacgagcaa

SEQ ID NO: 57021 - DNA, 20 bp, Artificial Sequence
  sgRNA
  Slc5a5_20
gaacacatctgtccagacca

SEQ ID NO: 57022 - DNA, 20 bp, Artificial Sequence
  sgRNA
  Slc5a6_1
cttacttaatcccagagatg

SEQ ID NO: 57023 - DNA, 20 bp, Artificial Sequence
  sgRNA
  Slc5a6_2
caaacatgaccagaccaatg

SEQ ID NO: 57024 - DNA, 20 bp, Artificial Sequence
  sgRNA
  Slc5a6_3
gcagttcaccaacggtatgg

SEQ ID NO: 57025 - DNA, 20 bp, Artificial Sequence
  sgRNA
  Slc5a6_4
atcctataggtgatatacat

SEQ ID NO: 57026 - DNA, 20 bp, Artificial Sequence
  sgRNA
  Slc5a6_5
ctgctcactgggggaatgcg

SEQ ID NO: 57027 - DNA, 20 bp, Artificial Sequence
  sgRNA
  Slc5a6_6
aggacagcacagacaaagag

SEQ ID NO: 57028 - DNA, 20 bp, Artificial Sequence
  sgRNA
  Slc5a6_7
ctgatggcagaccgcaaaat

SEQ ID NO: 57029 - DNA, 20 bp, Artificial Sequence
  sgRNA
  Slc5a6_8
gctcccaatgccgatccaga

SEQ ID NO: 57030 - DNA, 20 bp, Artificial Sequence
  sgRNA
  Slc5a6_9
gattgtcagtctgctcactg

SEQ ID NO: 57031 - DNA, 20 bp, Artificial Sequence
  sgRNA
  Slc5a6_10
accaatactgggttccaaat

SEQ ID NO: 57032 - DNA, 20 bp, Artificial Sequence
  sgRNA
  Slc5a6_11
attgtcagtctgctcactgg

SEQ ID NO: 57033 - DNA, 20 bp, Artificial Sequence
  sgRNA
  Slc5a6_12
gagcctgaggttgtatggaa

SEQ ID NO: 57034 - DNA, 20 bp, Artificial Sequence
  sgRNA
  Slc5a6_13
gtatctttggcatggttgga

SEQ ID NO: 57035 - DNA, 20 bp, Artificial Sequence
  sgRNA
  Slc5a6_14
gcggcgacagttacattggc

SEQ ID NO: 57036 - DNA, 20 bp, Artificial Sequence
  sgRNA
  Slc5a6_15
tacaacctcaggctccagcg

SEQ ID NO: 57037 - DNA, 20 bp, Artificial Sequence
  sgRNA
  Slc5a6_16
tccgaactgctttattgaag

SEQ ID NO: 57038 - DNA, 20 bp, Artificial Sequence
  sgRNA
  Slc5a6_17
aatgccgatccagaaggcca

SEQ ID NO: 57039 - DNA, 20 bp, Artificial Sequence
  sgRNA
  Slc5a6_18
cacagcggcgacagttacat

SEQ ID NO: 57040 - DNA, 20 bp, Artificial Sequence
  sgRNA
  Slc5a6_19
atacaacctcaggctccagc

SEQ ID NO: 57041 - DNA, 20 bp, Artificial Sequence
  sgRNA
  Slc5a6_20
agtcactgcattgagggcca

SEQ ID NO: 57042 - DNA, 20 bp, Artificial Sequence
  sgRNA
  Slc5a7_1
cacagctgtgaatccgatgt

SEQ ID NO: 57043 - DNA, 20 bp, Artificial Sequence
  sgRNA
  Slc5a7_2
cttgggatctggatacccgt

SEQ ID NO: 57044 - DNA, 20 bp, Artificial Sequence
  sgRNA
  Slc5a7_3
gcccaagctagaccacaacc

SEQ ID NO: 57045 - DNA, 20 bp, Artificial Sequence
  sgRNA
  Slc5a7_4
catggcaagcctacttccag

SEQ ID NO: 57046 - DNA, 20 bp, Artificial Sequence
  sgRNA
  Slc5a7_5
tcttgtcagagtaataacca

SEQ ID NO: 57047 - DNA, 20 bp, Artificial Sequence
  sgRNA
  Slc5a7_6
atagctcctatgcatatggc

SEQ ID NO: 57048 - DNA, 20 bp, Artificial Sequence
  sgRNA
  Slc5a7_7
gcgaaacctatgcgttccaa

SEQ ID NO: 57049 - DNA, 20 bp, Artificial Sequence
  sgRNA
  Slc5a7_8
atggcaagcctacttccaga

SEQ ID NO: 57050 - DNA, 20 bp, Artificial Sequence
  sgRNA
  Slc5a7_9
gatgttgattccagtccgga

SEQ ID NO: 57051 - DNA, 20 bp, Artificial Sequence
  sgRNA
  Slc5a7_10
gctctacccgccatatgcat

SEQ ID NO: 57052 - DNA, 20 bp, Artificial Sequence
  sgRNA
  Slc5a7_11
agtgaagccatcatagtcgg

SEQ ID NO: 57053 - DNA, 20 bp, Artificial Sequence
  sgRNA
  Slc5a7_12
tagctaccagtccttctacg

SEQ ID NO: 57054 - DNA, 20 bp, Artificial Sequence
  sgRNA
  Slc5a7_13
gattcaatggttcccagcca

SEQ ID NO: 57055 - DNA, 20 bp, Artificial Sequence
  sgRNA
  Slc5a7_14
agtcttcgtcagcaaagcca

SEQ ID NO: 57056 - DNA, 20 bp, Artificial Sequence
  sgRNA
  Slc5a7_15
catcctgcagtcaccgacat

SEQ ID NO: 57057 - DNA, 20 bp, Artificial Sequence
  sgRNA
  Slc5a7_16
tctggaagtaggcttgccat

SEQ ID NO: 57058 - DNA, 20 bp, Artificial Sequence
  sgRNA
  Slc5a7_17
gcttgggctcaggcacccat

SEQ ID NO: 57059 - DNA, 20 bp, Artificial Sequence
  sgRNA
  Slc5a7_18
tgatgttgattccagtccgg

SEQ ID NO: 57060 - DNA, 20 bp, Artificial Sequence
  sgRNA
  Slc5a7_19
acatctctcccatcagtgca

SEQ ID NO: 57061 - DNA, 20 bp, Artificial Sequence
  sgRNA
  Slc5a7_20
cagcccttaatcttctaccc

SEQ ID NO: 57062 - DNA, 20 bp, Artificial Sequence
  sgRNA
  Slc5a8_1
catctattacgccttcgcgg

SEQ ID NO: 57063 - DNA, 20 bp, Artificial Sequence
  sgRNA
  Slc5a8_2
cgccccaaaacggtagacct

SEQ ID NO: 57064 - DNA, 20 bp, Artificial Sequence
  sgRNA
  Slc5a8_3
tctgagagagacttaaagcg

SEQ ID NO: 57065 - DNA, 20 bp, Artificial Sequence
  sgRNA
  Slc5a8_4
caggcatcaataactcaaca

SEQ ID NO: 57066 - DNA, 20 bp, Artificial Sequence
  sgRNA
  Slc5a8_5
tgtagtggttatcagcgcgg

SEQ ID NO: 57067 - DNA, 20 bp, Artificial Sequence
  sgRNA
  Slc5a8_6
gctgtaacatcacgcacaat

SEQ ID NO: 57068 - DNA, 20 bp, Artificial Sequence
  sgRNA
  Slc5a8_7
gcatctattacgccttcgcg

SEQ ID NO: 57069 - DNA, 20 bp, Artificial Sequence
  sgRNA
  Slc5a8_8
tctctgagagagacttaaag

SEQ ID NO: 57070 - DNA, 20 bp, Artificial Sequence
  sgRNA
  Slc5a8_9
aggcatgctgctcatctcgg

SEQ ID NO: 57071 - DNA, 20 bp, Artificial Sequence
  sgRNA
  Slc5a8_10
gacactttcttagatgtcca

SEQ ID NO: 57072 - DNA, 20 bp, Artificial Sequence
  sgRNA
  Slc5a8_11
agtgcccaggacagtgacag

SEQ ID NO: 57073 - DNA, 20 bp, Artificial Sequence
  sgRNA
  Slc5a8_12
tccaaggactttcttatggg

SEQ ID NO: 57074 - DNA, 20 bp, Artificial Sequence
  sgRNA
  Slc5a8_13
tcacctgctccatattctgt

SEQ ID NO: 57075 - DNA, 20 bp, Artificial Sequence
  sgRNA
  Slc5a8_14
ctgtgaagttcagctcaaca

SEQ ID NO: 57076 - DNA, 20 bp, Artificial Sequence
  sgRNA
  Slc5a8_15
tctggacaattgtcattgga

SEQ ID NO: 57077 - DNA, 20 bp, Artificial Sequence
  sgRNA
  Slc5a8_16
agaacgtgtgtctttgcaaa

SEQ ID NO: 57078 - DNA, 20 bp, Artificial Sequence
  sgRNA
  Slc5a8_17
ggatcacccagaggcccaca

SEQ ID NO: 57079 - DNA, 20 bp, Artificial Sequence
  sgRNA
  Slc5a8_18
tgctgaatatcgccccaaaa

SEQ ID NO: 57080 - DNA, 20 bp, Artificial Sequence
  sgRNA
  Slc5a8_19
gcttatgccttatttggtgt

SEQ ID NO: 57081 - DNA, 20 bp, Artificial Sequence
  sgRNA
  Slc5a8_20
agcactcagcatattcggca

SEQ ID NO: 57082 - DNA, 20 bp, Artificial Sequence
  sgRNA
  Slc5a9_1
tacctgaagaaacgatttgg

SEQ ID NO: 57083 - DNA, 20 bp, Artificial Sequence
  sgRNA
  Slc5a9_2
tgagagccataaccagcttg

SEQ ID NO: 57084 - DNA, 20 bp, Artificial Sequence
  sgRNA
  Slc5a9_3
aagaatctttcacatgccaa

SEQ ID NO: 57085 - DNA, 20 bp, Artificial Sequence
  sgRNA
  Slc5a9_4
cagactgtgatcatggttgg

SEQ ID NO: 57086 - DNA, 20 bp, Artificial Sequence
  sgRNA
  Slc5a9_5
catccatccgtgcaagtcga

SEQ ID NO: 57087 - DNA, 20 bp, Artificial Sequence
  sgRNA
  Slc5a9_6
gattgtgcagaggtctctcg

SEQ ID NO: 57088 - DNA, 20 bp, Artificial Sequence
  sgRNA
  Slc5a9_7
gcgcttccgcaggcaggcat

SEQ ID NO: 57089 - DNA, 20 bp, Artificial Sequence
  sgRNA
  Slc5a9_8
ccaaaaatgagacctggcca

SEQ ID NO: 57090 - DNA, 20 bp, Artificial Sequence
  sgRNA
  Slc5a9_9
tcatccagagctccaatagt

SEQ ID NO: 57091 - DNA, 20 bp, Artificial Sequence
  sgRNA
  Slc5a9_10
gcagaagctgaccagcatcg

SEQ ID NO: 57092 - DNA, 20 bp, Artificial Sequence
  sgRNA
  Slc5a9_11
ataccacctgtcacctccca

SEQ ID NO: 57093 - DNA, 20 bp, Artificial Sequence
  sgRNA
  Slc5a9_12
tcttgcagaagatagccagc

SEQ ID NO: 57094 - DNA, 20 bp, Artificial Sequence
  sgRNA
  Slc5a9_13
gctactgctgttgaagatag

SEQ ID NO: 57095 - DNA, 20 bp, Artificial Sequence
  sgRNA
  Slc5a9_14
ctttaggtagccccctagca

SEQ ID NO: 57096 - DNA, 20 bp, Artificial Sequence
  sgRNA
  Slc5a9_15
tcatccatccgtgcaagtcg

SEQ ID NO: 57097 - DNA, 20 bp, Artificial Sequence
  sgRNA
  Slc5a9_16
ccacacatctatggcaaaca

SEQ ID NO: 57098 - DNA, 20 bp, Artificial Sequence
  sgRNA
  Slc5a9_17
agaggtgagtgagctcatga

SEQ ID NO: 57099 - DNA, 20 bp, Artificial Sequence
  sgRNA
  Slc5a9_18
aagaagcaaacaccactcag

SEQ ID NO: 57100 - DNA, 20 bp, Artificial Sequence
  sgRNA
  Slc5a9_19
gattacgacaatgatgatcg

SEQ ID NO: 57101 - DNA, 20 bp, Artificial Sequence
  sgRNA
  Slc5a9_20
agggacaaagatccagccca

SEQ ID NO: 57102 - DNA, 20 bp, Artificial Sequence
  sgRNA
  Slc6a1_1
caccaacatgaccagcgccg

SEQ ID NO: 57103 - DNA, 20 bp, Artificial Sequence
  sgRNA
  Slc6a1_2
gcagaaatacacgagcaccc

SEQ ID NO: 57104 - DNA, 20 bp, Artificial Sequence
  sgRNA
  Slc6a1_3
tacctctgtgggaaaaacgg

SEQ ID NO: 57105 - DNA, 20 bp, Artificial Sequence
  sgRNA
  Slc6a1_4
tccatgtgtcccggtcaggg

SEQ ID NO: 57106 - DNA, 20 bp, Artificial Sequence
  sgRNA
  Slc6a1_5
tctggggtactcgtccacca

SEQ ID NO: 57107 - DNA, 20 bp, Artificial Sequence
  sgRNA
  Slc6a1_6
ccgtggagtgacgcttcccg

SEQ ID NO: 57108 - DNA, 20 bp, Artificial Sequence
  sgRNA
  Slc6a1_7
ggaaacagtgtgacaacccg

SEQ ID NO: 57109 - DNA, 20 bp, Artificial Sequence
  sgRNA
  Slc6a1_8
acatgtaagccatgtacccg

SEQ ID NO: 57110 - DNA, 20 bp, Artificial Sequence
  sgRNA
  Slc6a1_9
gcgccagcttccatacgccc

SEQ ID NO: 57111 - DNA, 20 bp, Artificial Sequence
  sgRNA
  Slc6a1_10
tggcctgtctaacatcaccc

SEQ ID NO: 57112 - DNA, 20 bp, Artificial Sequence
  sgRNA
  Slc6a1_11
cttctgcaccttgactacca

SEQ ID NO: 57113 - DNA, 20 bp, Artificial Sequence
  sgRNA
  Slc6a1_12
aggacagcacagctgccgcg

SEQ ID NO: 57114 - DNA, 20 bp, Artificial Sequence
  sgRNA
  Slc6a1_13
cacagcttccaccagatgca

SEQ ID NO: 57115 - DNA, 20 bp, Artificial Sequence
  sgRNA
  Slc6a1_14
aagctggcgcccatgttcaa

SEQ ID NO: 57116 - DNA, 20 bp, Artificial Sequence
  sgRNA
  Slc6a1_15
gatctctactgaggtcagcg

SEQ ID NO: 57117 - DNA, 20 bp, Artificial Sequence
  sgRNA
  Slc6a1_16
gagcactccaaaaggaagag

SEQ ID NO: 57118 - DNA, 20 bp, Artificial Sequence
  sgRNA
  Slc6a1_17
ctgcttctccaactacagcc

SEQ ID NO: 57119 - DNA, 20 bp, Artificial Sequence
  sgRNA
  Slc6a1_18
tttgattattactctgccag

SEQ ID NO: 57120 - DNA, 20 bp, Artificial Sequence
  sgRNA
  Slc6a1_19
caaggtgcagaagaaggccg

SEQ ID NO: 57121 - DNA, 20 bp, Artificial Sequence
  sgRNA
  Slc6a1_20
gggcgcacaatatcttcact

SEQ ID NO: 57122 - DNA, 20 bp, Artificial Sequence
  sgRNA
  Slc6a11_1
ctcccagaactccatgaccg

SEQ ID NO: 57123 - DNA, 20 bp, Artificial Sequence
  sgRNA
  Slc6a11_2
aggcattggctatgcaacac

SEQ ID NO: 57124 - DNA, 20 bp, Artificial Sequence
  sgRNA
  Slc6a11_3
gttgttgtaactccccagag

SEQ ID NO: 57125 - DNA, 20 bp, Artificial Sequence
  sgRNA
  Slc6a11_4
gggtactaagtcgactggaa

SEQ ID NO: 57126 - DNA, 20 bp, Artificial Sequence
  sgRNA
  Slc6a11_5
gctgatcctcctgatccgag

SEQ ID NO: 57127 - DNA, 20 bp, Artificial Sequence
  sgRNA
  Slc6a11_6
gcagggtgtgcctattgccg

SEQ ID NO: 57128 - DNA, 20 bp, Artificial Sequence
  sgRNA
  Slc6a11_7
agcgccgatctgaaaatgcg

SEQ ID NO: 57129 - DNA, 20 bp, Artificial Sequence
  sgRNA
  Slc6a11_8
gcacattgggaacctccgtt

SEQ ID NO: 57130 - DNA, 20 bp, Artificial Sequence
  sgRNA
  Slc6a11_9
ataatgccagttcccaacgg

SEQ ID NO: 57131 - DNA, 20 bp, Artificial Sequence
  sgRNA
  Slc6a11_10
gtaccctaaggtcttccggc

SEQ ID NO: 57132 - DNA, 20 bp, Artificial Sequence
  sgRNA
  Slc6a11_11
cggccactggaacaacaagg

SEQ ID NO: 57133 - DNA, 20 bp, Artificial Sequence
  sgRNA
  Slc6a11_12
ggcattcctgattccttacg

SEQ ID NO: 57134 - DNA, 20 bp, Artificial Sequence
  sgRNA
  Slc6a11_13
cgtggtagacatgtacccta

SEQ ID NO: 57135 - DNA, 20 bp, Artificial Sequence
  sgRNA
  Slc6a11_14
ggcttcatggcatacgagca

SEQ ID NO: 57136 - DNA, 20 bp, Artificial Sequence
  sgRNA
  Slc6a11_15
tgtgttccactcgtgcccac

SEQ ID NO: 57137 - DNA, 20 bp, Artificial Sequence
  sgRNA
  Slc6a11_16
tctggatcttcattaagctg

SEQ ID NO: 57138 - DNA, 20 bp, Artificial Sequence
  sgRNA
  Slc6a11_17
ccaggatgagcagttctcgc

SEQ ID NO: 57139 - DNA, 20 bp, Artificial Sequence
  sgRNA
  Slc6a11_18
ctggggcagttcacgagcga

SEQ ID NO: 57140 - DNA, 20 bp, Artificial Sequence
  sgRNA
  Slc6a11_19
cttagggtacatgtctacca

SEQ ID NO: 57141 - DNA, 20 bp, Artificial Sequence
  sgRNA
  Slc6a11_20
tacctgtgctacaaaaacgg

SEQ ID NO: 57142 - DNA, 20 bp, Artificial Sequence
  sgRNA
  Slc6a12_1
ctgaatcactcatcggccag

SEQ ID NO: 57143 - DNA, 20 bp, Artificial Sequence
  sgRNA
  Slc6a12_2
tcttgggcctcatgtaggtg

SEQ ID NO: 57144 - DNA, 20 bp, Artificial Sequence
  sgRNA
  Slc6a12_3
gatggagtttgtgctgtcag

SEQ ID NO: 57145 - DNA, 20 bp, Artificial Sequence
  sgRNA
  Slc6a12_4
gggaatacccatttctgaag

SEQ ID NO: 57146 - DNA, 20 bp, Artificial Sequence
  sgRNA
  Slc6a12_5
cacgttgtcatagaaacggt

SEQ ID NO: 57147 - DNA, 20 bp, Artificial Sequence
  sgRNA
  Slc6a12_6
gctccgtctcaaggaccccc

SEQ ID NO: 57148 - DNA, 20 bp, Artificial Sequence
  sgRNA
  Slc6a12_7
ataagactcgatgaccacag

SEQ ID NO: 57149 - DNA, 20 bp, Artificial Sequence
  sgRNA
  Slc6a12_8
gctccgaaagagtggccggc

SEQ ID NO: 57150 - DNA, 20 bp, Artificial Sequence
  sgRNA
  Slc6a12_9
cctgttcagctccttcacct

SEQ ID NO: 57151 - DNA, 20 bp, Artificial Sequence
  sgRNA
  Slc6a12_10
tttgactactacgcctccag

SEQ ID NO: 57152 - DNA, 20 bp, Artificial Sequence
  sgRNA
  Slc6a12_11
ggacaacctgcaccaactcg

SEQ ID NO: 57153 - DNA, 20 bp, Artificial Sequence
  sgRNA
  Slc6a12_12
ccagaattccatgacaggcg

SEQ ID NO: 57154 - DNA, 20 bp, Artificial Sequence
  sgRNA
  Slc6a12_13
ctgattattcttctgatccg

SEQ ID NO: 57155 - DNA, 20 bp, Artificial Sequence
  sgRNA
  Slc6a12_14
tagacattgttgtatttgag

SEQ ID NO: 57156 - DNA, 20 bp, Artificial Sequence
  sgRNA
  Slc6a12_15
tgtgttccacgagttggtgc

SEQ ID NO: 57157 - DNA, 20 bp, Artificial Sequence
  sgRNA
  Slc6a12_16
ggactttctgaatcactcat

SEQ ID NO: 57158 - DNA, 20 bp, Artificial Sequence
  sgRNA
  Slc6a12_17
cgaccgtttctatgacaacg

SEQ ID NO: 57159 - DNA, 20 bp, Artificial Sequence
  sgRNA
  Slc6a12_18
tttcctttgccatctgccag

SEQ ID NO: 57160 - DNA, 20 bp, Artificial Sequence
  sgRNA
  Slc6a12_19
tcaggtagaagacgatgccc

SEQ ID NO: 57161 - DNA, 20 bp, Artificial Sequence
  sgRNA
  Slc6a12_20
gagttggtgcaggttgtcca

SEQ ID NO: 57162 - DNA, 20 bp, Artificial Sequence
  sgRNA
  Slc6a13_1
cttggccagtacaccaacca

SEQ ID NO: 57163 - DNA, 20 bp, Artificial Sequence
  sgRNA
  Slc6a13_2
gtaacatcaccacagctcga

SEQ ID NO: 57164 - DNA, 20 bp, Artificial Sequence
  sgRNA
  Slc6a13_3
accccaacatcacacgtctg

SEQ ID NO: 57165 - DNA, 20 bp, Artificial Sequence
  sgRNA
  Slc6a13_4
ccagaactcgatgacagggg

SEQ ID NO: 57166 - DNA, 20 bp, Artificial Sequence
  sgRNA
  Slc6a13_5
tcatggctgcaacttcccca

SEQ ID NO: 57167 - DNA, 20 bp, Artificial Sequence
  sgRNA
  Slc6a13_6
ctatctctgctacaagaacg

SEQ ID NO: 57168 - DNA, 20 bp, Artificial Sequence
  sgRNA
  Slc6a13_7
gttccgtaagaagaatcgga

SEQ ID NO: 57169 - DNA, 20 bp, Artificial Sequence
  sgRNA
  Slc6a13_8
tgttccgtaagaagaatcgg

SEQ ID NO: 57170 - DNA, 20 bp, Artificial Sequence
  sgRNA
  Slc6a13_9
cagagctaggagccacccta

SEQ ID NO: 57171 - DNA, 20 bp, Artificial Sequence
  sgRNA
  Slc6a13_10
ttcttcttacggaacacccg

SEQ ID NO: 57172 - DNA, 20 bp, Artificial Sequence
  sgRNA
  Slc6a13_11
aggcgatgaatgccaggcca

SEQ ID NO: 57173 - DNA, 20 bp, Artificial Sequence
  sgRNA
  Slc6a13_12
catcgcctaccctcgagctg

SEQ ID NO: 57174 - DNA, 20 bp, Artificial Sequence
  sgRNA
  Slc6a13_13
gttccagtgctcccgttcca

SEQ ID NO: 57175 - DNA, 20 bp, Artificial Sequence
  sgRNA
  Slc6a13_14
tacaagctgaggactctcaa

SEQ ID NO: 57176 - DNA, 20 bp, Artificial Sequence
  sgRNA
  Slc6a13_15
ggagcactggaacaacaaga

SEQ ID NO: 57177 - DNA, 20 bp, Artificial Sequence
  sgRNA
  Slc6a13_16
acaagaagtacacgtaccca

SEQ ID NO: 57178 - DNA, 20 bp, Artificial Sequence
  sgRNA
  Slc6a13_17
gtgtcactcctcgaatcaac

SEQ ID NO: 57179 - DNA, 20 bp, Artificial Sequence
  sgRNA
  Slc6a13_18
agggaggcatcacagcctgg

SEQ ID NO: 57180 - DNA, 20 bp, Artificial Sequence
  sgRNA
  Slc6a13_19
gcagggtgtgcccatatctg

SEQ ID NO: 57181 - DNA, 20 bp, Artificial Sequence
  sgRNA
  Slc6a13_20
tgtagcttcccagggccgtg

SEQ ID NO: 57182 - DNA, 20 bp, Artificial Sequence
  sgRNA
  Slc6a15_1
ttcccggtaccagtaatagg

SEQ ID NO: 57183 - DNA, 20 bp, Artificial Sequence
  sgRNA
  Slc6a15_2
gaaacatataaggaccacgt

SEQ ID NO: 57184 - DNA, 20 bp, Artificial Sequence
  sgRNA
  Slc6a15_3
ttgttccaaacatgctgccg

SEQ ID NO: 57185 - DNA, 20 bp, Artificial Sequence
  sgRNA
  Slc6a15_4
acataagccctaaattgggt

SEQ ID NO: 57186 - DNA, 20 bp, Artificial Sequence
  sgRNA
  Slc6a15_5
atccatgcattatatccggg

SEQ ID NO: 57187 - DNA, 20 bp, Artificial Sequence
  sgRNA
  Slc6a15_6
aagatgaccacaattagcag

SEQ ID NO: 57188 - DNA, 20 bp, Artificial Sequence
  sgRNA
  Slc6a15_7
tcctctcttataggtcacgg

SEQ ID NO: 57189 - DNA, 20 bp, Artificial Sequence
  sgRNA
  Slc6a15_8
atgttgataaatctcggcct

SEQ ID NO: 57190 - DNA, 20 bp, Artificial Sequence
  sgRNA
  Slc6a15_9
gcctccgtgacctataagag

SEQ ID NO: 57191 - DNA, 20 bp, Artificial Sequence
  sgRNA
  Slc6a15_10
ccaatcccatagcgtccatt

SEQ ID NO: 57192 - DNA, 20 bp, Artificial Sequence
  sgRNA
  Slc6a15_11
gtcctcccggatataatgca

SEQ ID NO: 57193 - DNA, 20 bp, Artificial Sequence
  sgRNA
  Slc6a15_12
gacgaatgatgaacaccact

SEQ ID NO: 57194 - DNA, 20 bp, Artificial Sequence
  sgRNA
  Slc6a15_13
cagttctctgttcccctacg

SEQ ID NO: 57195 - DNA, 20 bp, Artificial Sequence
  sgRNA
  Slc6a15_14
acactggatactgctcccaa

SEQ ID NO: 57196 - DNA, 20 bp, Artificial Sequence
  sgRNA
  Slc6a15_15
tccttgggatcaatgccccc

SEQ ID NO: 57197 - DNA, 20 bp, Artificial Sequence
  sgRNA
  Slc6a15_16
tcatctccttccaagttcac

SEQ ID NO: 57198 - DNA, 20 bp, Artificial Sequence
  sgRNA
  Slc6a15_17
agccaatacaaaatgccagg

SEQ ID NO: 57199 - DNA, 20 bp, Artificial Sequence
  sgRNA
  Slc6a15_18
gcatgtttggaacaattgaa

SEQ ID NO: 57200 - DNA, 20 bp, Artificial Sequence
  sgRNA
  Slc6a15_19
ttgtggataccttcaaagtg

SEQ ID NO: 57201 - DNA, 20 bp, Artificial Sequence
  sgRNA
  Slc6a15_20
ttactggtaccgggaagcac

SEQ ID NO: 57202 - DNA, 20 bp, Artificial Sequence
  sgRNA
  Slc6a16_1
ggtaattcttgccaaagcga

SEQ ID NO: 57203 - DNA, 20 bp, Artificial Sequence
  sgRNA
  Slc6a16_2
ggcagtatacaaagtatgca

SEQ ID NO: 57204 - DNA, 20 bp, Artificial Sequence
  sgRNA
  Slc6a16_3
tcaatgggatcaagtccatt

SEQ ID NO: 57205 - DNA, 20 bp, Artificial Sequence
  sgRNA
  Slc6a16_4
gccgcacaggaacatcgcca

SEQ ID NO: 57206 - DNA, 20 bp, Artificial Sequence
  sgRNA
  Slc6a16_5
tcttcgtataccttgtcaag

SEQ ID NO: 57207 - DNA, 20 bp, Artificial Sequence
  sgRNA
  Slc6a16_6
gcgtacatcttgatgctgtt

SEQ ID NO: 57208 - DNA, 20 bp, Artificial Sequence
  sgRNA
  Slc6a16_7
agtggggtacagcatggtta

SEQ ID NO: 57209 - DNA, 20 bp, Artificial Sequence
  sgRNA
  Slc6a16_8
ccatccagtaagctaccact

SEQ ID NO: 57210 - DNA, 20 bp, Artificial Sequence
  sgRNA
  Slc6a16_9
gcagccttcccccacccttg

SEQ ID NO: 57211 - DNA, 20 bp, Artificial Sequence
  sgRNA
  Slc6a16_10
agaattgaacacgttcaggt

SEQ ID NO: 57212 - DNA, 20 bp, Artificial Sequence
  sgRNA
  Slc6a16_11
gtcttcgtataccttgtcaa

SEQ ID NO: 57213 - DNA, 20 bp, Artificial Sequence
  sgRNA
  Slc6a16_12
cctcatccggactctgtcga

SEQ ID NO: 57214 - DNA, 20 bp, Artificial Sequence
  sgRNA
  Slc6a16_13
gaggagcgccgttctcagcg

SEQ ID NO: 57215 - DNA, 20 bp, Artificial Sequence
  sgRNA
  Slc6a16_14
tatggccgatgccttcttaa

SEQ ID NO: 57216 - DNA, 20 bp, Artificial Sequence
  sgRNA
  Slc6a16_15
agatcaggaacaggaagcga

SEQ ID NO: 57217 - DNA, 20 bp, Artificial Sequence
  sgRNA
  Slc6a16_16
agatctgaagggaatcccca

SEQ ID NO: 57218 - DNA, 20 bp, Artificial Sequence
  sgRNA
  Slc6a16_17
gttggtgaacaggatgagca

SEQ ID NO: 57219 - DNA, 20 bp, Artificial Sequence
  sgRNA
  Slc6a16_18
cctgttcctgatcttcactg

SEQ ID NO: 57220 - DNA, 20 bp, Artificial Sequence
  sgRNA
  Slc6a16_19
agtaagctaccactgggcag

SEQ ID NO: 57221 - DNA, 20 bp, Artificial Sequence
  sgRNA
  Slc6a16_20
acaggcctagcaccaccatt

SEQ ID NO: 57222 - DNA, 20 bp, Artificial Sequence
  sgRNA
  Slc6a17_1
cacgagggtggccaacaccg

SEQ ID NO: 57223 - DNA, 20 bp, Artificial Sequence
  sgRNA
  Slc6a17_2
ggcctctcggtaccaaaagt

SEQ ID NO: 57224 - DNA, 20 bp, Artificial Sequence
  sgRNA
  Slc6a17_3
tgtagtacagcccaacgaag

SEQ ID NO: 57225 - DNA, 20 bp, Artificial Sequence
  sgRNA
  Slc6a17_4
gaacatgacggaccagaacg

SEQ ID NO: 57226 - DNA, 20 bp, Artificial Sequence
  sgRNA
  Slc6a17_5
ccagcacagcaaacaccacg

SEQ ID NO: 57227 - DNA, 20 bp, Artificial Sequence
  sgRNA
  Slc6a17_6
ggattgttgctgttatccaa

SEQ ID NO: 57228 - DNA, 20 bp, Artificial Sequence
  sgRNA
  Slc6a17_7
gccgcaggatgaacaccaca

SEQ ID NO: 57229 - DNA, 20 bp, Artificial Sequence
  sgRNA
  Slc6a17_8
acttccacttgctctccgac

SEQ ID NO: 57230 - DNA, 20 bp, Artificial Sequence
  sgRNA
  Slc6a17_9
tgtccagctcatcctccaag

SEQ ID NO: 57231 - DNA, 20 bp, Artificial Sequence
  sgRNA
  Slc6a17_10
gctcagctactacctacttt

SEQ ID NO: 57232 - DNA, 20 bp, Artificial Sequence
  sgRNA
  Slc6a17_11
ggccgaatagtcatcaaaca

SEQ ID NO: 57233 - DNA, 20 bp, Artificial Sequence
  sgRNA
  Slc6a17_12
gtgggccagaggatccgccg

SEQ ID NO: 57234 - DNA, 20 bp, Artificial Sequence
  sgRNA
  Slc6a17_13
agctcatcctccaagaggca

SEQ ID NO: 57235 - DNA, 20 bp, Artificial Sequence
  sgRNA
  Slc6a17_14
cgatgctccaggccacaagg

SEQ ID NO: 57236 - DNA, 20 bp, Artificial Sequence
  sgRNA
  Slc6a17_15
gctgatcaccctcattgccg

SEQ ID NO: 57237 - DNA, 20 bp, Artificial Sequence
  sgRNA
  Slc6a17_16
tggcaagcagaaggtggcgg

SEQ ID NO: 57238 - DNA, 20 bp, Artificial Sequence
  sgRNA
  Slc6a17_17
acagtcccattcctgatgac

SEQ ID NO: 57239 - DNA, 20 bp, Artificial Sequence
  sgRNA
  Slc6a17_18
agcaggccaacaccacataa

SEQ ID NO: 57240 - DNA, 20 bp, Artificial Sequence
  sgRNA
  Slc6a17_19
gtacatctctgagtagtcct

SEQ ID NO: 57241 - DNA, 20 bp, Artificial Sequence
  sgRNA
  Slc6a17_20
gtgtctttgcattcttcgtg

SEQ ID NO: 57242 - DNA, 20 bp, Artificial Sequence
  sgRNA
  Slc6a18_1
agagcgtacctacgccaccg

SEQ ID NO: 57243 - DNA, 20 bp, Artificial Sequence
  sgRNA
  Slc6a18_2
gtgtacctgtgtgtcatcag

SEQ ID NO: 57244 - DNA, 20 bp, Artificial Sequence
  sgRNA
  Slc6a18_3
gaatgccactcagactgcga

SEQ ID NO: 57245 - DNA, 20 bp, Artificial Sequence
  sgRNA
  Slc6a18_4
ttgcaagctacaacccaccc

SEQ ID NO: 57246 - DNA, 20 bp, Artificial Sequence
  sgRNA
  Slc6a18_5
ggaagaaccataagacccac

SEQ ID NO: 57247 - DNA, 20 bp, Artificial Sequence
  sgRNA
  Slc6a18_6
gcaacacaggcactatccaa

SEQ ID NO: 57248 - DNA, 20 bp, Artificial Sequence
  sgRNA
  Slc6a18_7
gctgcatccaaccacacccg

SEQ ID NO: 57249 - DNA, 20 bp, Artificial Sequence
  sgRNA
  Slc6a18_8
tgaagactcttcagaatcca

SEQ ID NO: 57250 - DNA, 20 bp, Artificial Sequence
  sgRNA
  Slc6a18_9
aagaccatctccccttacct

SEQ ID NO: 57251 - DNA, 20 bp, Artificial Sequence
  sgRNA
  Slc6a18_10
tcagaggcattgagagcacg

SEQ ID NO: 57252 - DNA, 20 bp, Artificial Sequence
  sgRNA
  Slc6a18_11
tcatcctcaatgtccacaag

SEQ ID NO: 57253 - DNA, 20 bp, Artificial Sequence
  sgRNA
  Slc6a18_12
aggcaaagcagatcacccct

SEQ ID NO: 57254 - DNA, 20 bp, Artificial Sequence
  sgRNA
  Slc6a18_13
cgggataccctcaaagacca

SEQ ID NO: 57255 - DNA, 20 bp, Artificial Sequence
  sgRNA
  Slc6a18_14
agatggttagcaccaggtaa

SEQ ID NO: 57256 - DNA, 20 bp, Artificial Sequence
  sgRNA
  Slc6a18_15
aggcatccaatgactatgga

SEQ ID NO: 57257 - DNA, 20 bp, Artificial Sequence
  sgRNA
  Slc6a18_16
ttccaggccttgtaactggg

SEQ ID NO: 57258 - DNA, 20 bp, Artificial Sequence
  sgRNA
  Slc6a18_17
ttctacatcgagcttgccat

SEQ ID NO: 57259 - DNA, 20 bp, Artificial Sequence
  sgRNA
  Slc6a18_18
tccagagcttagcatctcca

SEQ ID NO: 57260 - DNA, 20 bp, Artificial Sequence
  sgRNA
  Slc6a18_19
tgaggaagatggttagcacc

SEQ ID NO: 57261 - DNA, 20 bp, Artificial Sequence
  sgRNA
  Slc6a18_20
cattggccagcgcctacgga

SEQ ID NO: 57262 - DNA, 20 bp, Artificial Sequence
  sgRNA
  Slc6a19_1
atcggtcagaggctacgcaa

SEQ ID NO: 57263 - DNA, 20 bp, Artificial Sequence
  sgRNA
  Slc6a19_2
acagtcatcaaagcgctcag

SEQ ID NO: 57264 - DNA, 20 bp, Artificial Sequence
  sgRNA
  Slc6a19_3
agctgagcaaccccaacacg

SEQ ID NO: 57265 - DNA, 20 bp, Artificial Sequence
  sgRNA
  Slc6a19_4
tccgtggcatcgagaccact

SEQ ID NO: 57266 - DNA, 20 bp, Artificial Sequence
  sgRNA
  Slc6a19_5
aatgggttcgacctgccgga

SEQ ID NO: 57267 - DNA, 20 bp, Artificial Sequence
  sgRNA
  Slc6a19_6
tcggtaccagaagtagtcca

SEQ ID NO: 57268 - DNA, 20 bp, Artificial Sequence
  sgRNA
  Slc6a19_7
aactccatacacgtagacga

SEQ ID NO: 57269 - DNA, 20 bp, Artificial Sequence
  sgRNA
  Slc6a19_8
caaaaggcgatgattagcag

SEQ ID NO: 57270 - DNA, 20 bp, Artificial Sequence
  sgRNA
  Slc6a19_9
ctgtacctggagtttgccat

SEQ ID NO: 57271 - DNA, 20 bp, Artificial Sequence
  sgRNA
  Slc6a19_10
aagtcacattgccctccggc

SEQ ID NO: 57272 - DNA, 20 bp, Artificial Sequence
  sgRNA
  Slc6a19_11
acttgtagatggcaaagcag

SEQ ID NO: 57273 - DNA, 20 bp, Artificial Sequence
  sgRNA
  Slc6a19_12
ggtcttctactccttctcac

SEQ ID NO: 57274 - DNA, 20 bp, Artificial Sequence
  sgRNA
  Slc6a19_13
cacccttcagagtcaagcca

SEQ ID NO: 57275 - DNA, 20 bp, Artificial Sequence
  sgRNA
  Slc6a19_14
gcaaactccaggtacagcaa

SEQ ID NO: 57276 - DNA, 20 bp, Artificial Sequence
  sgRNA
  Slc6a19_15
aagatggtcagtacaacata

SEQ ID NO: 57277 - DNA, 20 bp, Artificial Sequence
  sgRNA
  Slc6a19_16
gtgtgccaagagctcttccg

SEQ ID NO: 57278 - DNA, 20 bp, Artificial Sequence
  sgRNA
  Slc6a19_17
aatgatggagtagaccacgg

SEQ ID NO: 57279 - DNA, 20 bp, Artificial Sequence
  sgRNA
  Slc6a19_18
acatcttctggcaagtcacg

SEQ ID NO: 57280 - DNA, 20 bp, Artificial Sequence
  sgRNA
  Slc6a19_19
ggacattcactccatggcag

SEQ ID NO: 57281 - DNA, 20 bp, Artificial Sequence
  sgRNA
  Slc6a19_20
catcggtcagaggctacgca

SEQ ID NO: 57282 - DNA, 20 bp, Artificial Sequence
  sgRNA
  Slc6a2_1
cttcaccactagtagatcgg

SEQ ID NO: 57283 - DNA, 20 bp, Artificial Sequence
  sgRNA
  Slc6a2_2
agcagtgggatccatgacat

SEQ ID NO: 57284 - DNA, 20 bp, Artificial Sequence
  sgRNA
  Slc6a2_3
agccgacatagagggcaatg

SEQ ID NO: 57285 - DNA, 20 bp, Artificial Sequence
  sgRNA
  Slc6a2_4
ataagggaaccgccacacgt

SEQ ID NO: 57286 - DNA, 20 bp, Artificial Sequence
  sgRNA
  Slc6a2_5
agtggcctacggaatcaccc

SEQ ID NO: 57287 - DNA, 20 bp, Artificial Sequence
  sgRNA
  Slc6a2_6
gagtgtccgcagttggtcca

SEQ ID NO: 57288 - DNA, 20 bp, Artificial Sequence
  sgRNA
  Slc6a2_7
gcttaaaccccatcatctgc

SEQ ID NO: 57289 - DNA, 20 bp, Artificial Sequence
  sgRNA
  Slc6a2_8
caggtggtgctcattctccg

SEQ ID NO: 57290 - DNA, 20 bp, Artificial Sequence
  sgRNA
  Slc6a2_9
gccagctccatgtaaaacag

SEQ ID NO: 57291 - DNA, 20 bp, Artificial Sequence
  sgRNA
  Slc6a2_10
actacaatgtcatcatcgcc

SEQ ID NO: 57292 - DNA, 20 bp, Artificial Sequence
  sgRNA
  Slc6a2_11
ctagtggtgaaggaacgcaa

SEQ ID NO: 57293 - DNA, 20 bp, Artificial Sequence
  sgRNA
  Slc6a2_12
ggggcaatacaaccgggagg

SEQ ID NO: 57294 - DNA, 20 bp, Artificial Sequence
  sgRNA
  Slc6a2_13
tctggggcaatacaaccggg

SEQ ID NO: 57295 - DNA, 20 bp, Artificial Sequence
  sgRNA
  Slc6a2_14
gtttggggtccgtacagttg

SEQ ID NO: 57296 - DNA, 20 bp, Artificial Sequence
  sgRNA
  Slc6a2_15
atgtcttcactcctttccag

SEQ ID NO: 57297 - DNA, 20 bp, Artificial Sequence
  sgRNA
  Slc6a2_16
gtgtagtcatcataggtaag

SEQ ID NO: 57298 - DNA, 20 bp, Artificial Sequence
  sgRNA
  Slc6a2_17
gatttcctgctgtccgtggt

SEQ ID NO: 57299 - DNA, 20 bp, Artificial Sequence
  sgRNA
  Slc6a2_18
gcagcagctgccattgaggc

SEQ ID NO: 57300 - DNA, 20 bp, Artificial Sequence
  sgRNA
  Slc6a2_19
tgacttctaccgcctcaagg

SEQ ID NO: 57301 - DNA, 20 bp, Artificial Sequence
  sgRNA
  Slc6a2_20
ggatcctgacagagtagaga

SEQ ID NO: 57302 - DNA, 20 bp, Artificial Sequence
  sgRNA
  Slc6a20a_1
tacatgttcacacctaaggt

SEQ ID NO: 57303 - DNA, 20 bp, Artificial Sequence
  sgRNA
  Slc6a20a_2
aacacagtaaggcatcgatg

SEQ ID NO: 57304 - DNA, 20 bp, Artificial Sequence
  sgRNA
  Slc6a20a_3
gacaatgctggcaaatatgg

SEQ ID NO: 57305 - DNA, 20 bp, Artificial Sequence
  sgRNA
  Slc6a20a_4
caaccacacaggctacgatg

SEQ ID NO: 57306 - DNA, 20 bp, Artificial Sequence
  sgRNA
  Slc6a20a_5
ccacatgcgctagctgtcat

SEQ ID NO: 57307 - DNA, 20 bp, Artificial Sequence
  sgRNA
  Slc6a20a_6
caggcgaacacgaactgcag

SEQ ID NO: 57308 - DNA, 20 bp, Artificial Sequence
  sgRNA
  Slc6a20a_7
ctccatggagtgtaaggcca

SEQ ID NO: 57309 - DNA, 20 bp, Artificial Sequence
  sgRNA
  Slc6a20a_8
catcaggaatcgcctcaaga

SEQ ID NO: 57310 - DNA, 20 bp, Artificial Sequence
  sgRNA
  Slc6a20a_9
ccttacctgtgccagatgta

SEQ ID NO: 57311 - DNA, 20 bp, Artificial Sequence
  sgRNA
  Slc6a20a_10
tgacagctagcgcatgtggg

SEQ ID NO: 57312 - DNA, 20 bp, Artificial Sequence
  sgRNA
  Slc6a20a_11
gcctgcatctcctacgccgt

SEQ ID NO: 57313 - DNA, 20 bp, Artificial Sequence
  sgRNA
  Slc6a20a_12
tacctgtgccagatgtacgg

SEQ ID NO: 57314 - DNA, 20 bp, Artificial Sequence
  sgRNA
  Slc6a20a_13
ccacacgttgcccaaaccca

SEQ ID NO: 57315 - DNA, 20 bp, Artificial Sequence
  sgRNA
  Slc6a20a_14
atgctgctgatgctgggtat

SEQ ID NO: 57316 - DNA, 20 bp, Artificial Sequence
  sgRNA
  Slc6a20a_15
cgtacatctggcacaggtaa

SEQ ID NO: 57317 - DNA, 20 bp, Artificial Sequence
  sgRNA
  Slc6a20a_16
ggtactgcagtgttcccgtg

SEQ ID NO: 57318 - DNA, 20 bp, Artificial Sequence
  sgRNA
  Slc6a20a_17
gaagaaggagaccacaacac

SEQ ID NO: 57319 - DNA, 20 bp, Artificial Sequence
  sgRNA
  Slc6a20a_18
aacactgcagtaccaagcct

SEQ ID NO: 57320 - DNA, 20 bp, Artificial Sequence
  sgRNA
  Slc6a20a_19
attcctgatgaaagtcccca

SEQ ID NO: 57321 - DNA, 20 bp, Artificial Sequence
  sgRNA
  Slc6a20a_20
cgaacacgaactgcagcgga

SEQ ID NO: 57322 - DNA, 20 bp, Artificial Sequence
  sgRNA
  Slc6a20b_1
ccactgaatagtaatcacac

SEQ ID NO: 57323 - DNA, 20 bp, Artificial Sequence
  sgRNA
  Slc6a20b_2
ctgtgccagatgtatggcgg

SEQ ID NO: 57324 - DNA, 20 bp, Artificial Sequence
  sgRNA
  Slc6a20b_3
gatgacattgaagtacacag

SEQ ID NO: 57325 - DNA, 20 bp, Artificial Sequence
  sgRNA
  Slc6a20b_4
cacaaagtaaggcagtgacg

SEQ ID NO: 57326 - DNA, 20 bp, Artificial Sequence
  sgRNA
  Slc6a20b_5
ggtactgcagcgttcccgtg

SEQ ID NO: 57327 - DNA, 20 bp, Artificial Sequence
  sgRNA
  Slc6a20b_6
gtcagcacccaggaagaccg

SEQ ID NO: 57328 - DNA, 20 bp, Artificial Sequence
  sgRNA
  Slc6a20b_7
gataatccttagtcaccacg

SEQ ID NO: 57329 - DNA, 20 bp, Artificial Sequence
  sgRNA
  Slc6a20b_8
ggaagcgccatacattgccc

SEQ ID NO: 57330 - DNA, 20 bp, Artificial Sequence
  sgRNA
  Slc6a20b_9
gagctcctcatcctctggca

SEQ ID NO: 57331 - DNA, 20 bp, Artificial Sequence
  sgRNA
  Slc6a20b_10
atgttgctaacactgggtat

SEQ ID NO: 57332 - DNA, 20 bp, Artificial Sequence
  sgRNA
  Slc6a20b_11
aagtccccagggctaccaga

SEQ ID NO: 57333 - DNA, 20 bp, Artificial Sequence
  sgRNA
  Slc6a20b_12
attgatgacagacacaatga

SEQ ID NO: 57334 - DNA, 20 bp, Artificial Sequence
  sgRNA
  Slc6a20b_13
cctgtgtgattactattcag

SEQ ID NO: 57335 - DNA, 20 bp, Artificial Sequence
  sgRNA
  Slc6a20b_14
tgatcttgctgtcagtcaga

SEQ ID NO: 57336 - DNA, 20 bp, Artificial Sequence
  sgRNA
  Slc6a20b_15
ctttgtgctcatcatctacc

SEQ ID NO: 57337 - DNA, 20 bp, Artificial Sequence
  sgRNA
  Slc6a20b_16
gatcttgctgtcagtcagag

SEQ ID NO: 57338 - DNA, 20 bp, Artificial Sequence
  sgRNA
  Slc6a20b_17
aatgagcagcagagacagcg

SEQ ID NO: 57339 - DNA, 20 bp, Artificial Sequence
  sgRNA
  Slc6a20b_18
tacctgtgccagatgtatgg

SEQ ID NO: 57340 - DNA, 20 bp, Artificial Sequence
  sgRNA
  Slc6a20b_19
cctcaactgtgccattggca

SEQ ID NO: 57341 - DNA, 20 bp, Artificial Sequence
  sgRNA
  Slc6a20b_20
gcgtgtgacaaaagtcccca

SEQ ID NO: 57342 - DNA, 20 bp, Artificial Sequence
  sgRNA
  Slc6a3_1
tagatgatgaagatcaaccc

SEQ ID NO: 57343 - DNA, 20 bp, Artificial Sequence
  sgRNA
  Slc6a3_2
gctcgtcagggagttaatgg

SEQ ID NO: 57344 - DNA, 20 bp, Artificial Sequence
  sgRNA
  Slc6a3_3
cagggagggtgactccacgc

SEQ ID NO: 57345 - DNA, 20 bp, Artificial Sequence
  sgRNA
  Slc6a3_4
ttactcaaaatactcagcag

SEQ ID NO: 57346 - DNA, 20 bp, Artificial Sequence
  sgRNA
  Slc6a3_5
gtagaaccaggccaccccaa

SEQ ID NO: 57347 - DNA, 20 bp, Artificial Sequence
  sgRNA
  Slc6a3_6
gcatagccgccagtacaggt

SEQ ID NO: 57348 - DNA, 20 bp, Artificial Sequence
  sgRNA
  Slc6a3_7
atgtaggctccatagtgtgg

SEQ ID NO: 57349 - DNA, 20 bp, Artificial Sequence
  sgRNA
  Slc6a3_8
ggagtgtggcgattgcctca

SEQ ID NO: 57350 - DNA, 20 bp, Artificial Sequence
  sgRNA
  Slc6a3_9
caggctgcagaacttatagg

SEQ ID NO: 57351 - DNA, 20 bp, Artificial Sequence
  sgRNA
  Slc6a3_10
gcgtggagtcaccctccctg

SEQ ID NO: 57352 - DNA, 20 bp, Artificial Sequence
  sgRNA
  Slc6a3_11
gcagaacaatgaccagcacc

SEQ ID NO: 57353 - DNA, 20 bp, Artificial Sequence
  sgRNA
  Slc6a3_12
ataagttctgcagcctgcca

SEQ ID NO: 57354 - DNA, 20 bp, Artificial Sequence
  sgRNA
  Slc6a3_13
ctacaatgtcatcattgcat

SEQ ID NO: 57355 - DNA, 20 bp, Artificial Sequence
  sgRNA
  Slc6a3_14
gctaaagagcccaatgctgt

SEQ ID NO: 57356 - DNA, 20 bp, Artificial Sequence
  sgRNA
  Slc6a3_15
gatttcctgctctcagtcat

SEQ ID NO: 57357 - DNA, 20 bp, Artificial Sequence
  sgRNA
  Slc6a3_16
gtagggaaacctccagacat

SEQ ID NO: 57358 - DNA, 20 bp, Artificial Sequence
  sgRNA
  Slc6a3_17
catagcagcaactctagcga

SEQ ID NO: 57359 - DNA, 20 bp, Artificial Sequence
  sgRNA
  Slc6a3_18
agcattgggctctttagccg

SEQ ID NO: 57360 - DNA, 20 bp, Artificial Sequence
  sgRNA
  Slc6a3_19
ggtgactccacgcaggagca

SEQ ID NO: 57361 - DNA, 20 bp, Artificial Sequence
  sgRNA
  Slc6a3_20
ttgatgacctgggccctcca

SEQ ID NO: 57362 - DNA, 20 bp, Artificial Sequence
  sgRNA
  Slc6a4_1
agttcccagtacaagcgctg

SEQ ID NO: 57363 - DNA, 20 bp, Artificial Sequence
  sgRNA
  Slc6a4_2
aggagtcaaaacgtctggca

SEQ ID NO: 57364 - DNA, 20 bp, Artificial Sequence
  sgRNA
  Slc6a4_3
tacatatgctaccagaatgg

SEQ ID NO: 57365 - DNA, 20 bp, Artificial Sequence
  sgRNA
  Slc6a4_4
ccgcatatgtgatgaaaagg

SEQ ID NO: 57366 - DNA, 20 bp, Artificial Sequence
  sgRNA
  Slc6a4_5
acaccaacggaaattccgtg

SEQ ID NO: 57367 - DNA, 20 bp, Artificial Sequence
  sgRNA
  Slc6a4_6
atagaaccaagacacgacga

SEQ ID NO: 57368 - DNA, 20 bp, Artificial Sequence
  sgRNA
  Slc6a4_7
tgttgtagctagcaaacgcc

SEQ ID NO: 57369 - DNA, 20 bp, Artificial Sequence
  sgRNA
  Slc6a4_8
tcacatctgggccaagcgca

SEQ ID NO: 57370 - DNA, 20 bp, Artificial Sequence
  sgRNA
  Slc6a4_9
agatcctccaaaaccatccg

SEQ ID NO: 57371 - DNA, 20 bp, Artificial Sequence
  sgRNA
  Slc6a4_10
gggaactgcggagtacccat

SEQ ID NO: 57372 - DNA, 20 bp, Artificial Sequence
  sgRNA
  Slc6a4_11
aacccagcgtgattaacatg

SEQ ID NO: 57373 - DNA, 20 bp, Artificial Sequence
  sgRNA
  Slc6a4_12
gggcctggacaaatatccaa

SEQ ID NO: 57374 - DNA, 20 bp, Artificial Sequence
  sgRNA
  Slc6a4_13
atttcggtggtactggccca

SEQ ID NO: 57375 - DNA, 20 bp, Artificial Sequence
  sgRNA
  Slc6a4_14
gttcaccacactggtcacca

SEQ ID NO: 57376 - DNA, 20 bp, Artificial Sequence
  sgRNA
  Slc6a4_15
gctcaccgtggctctcatcg

SEQ ID NO: 57377 - DNA, 20 bp, Artificial Sequence
  sgRNA
  Slc6a4_16
tgatgagtccaccccaactc

SEQ ID NO: 57378 - DNA, 20 bp, Artificial Sequence
  sgRNA
  Slc6a4_17
ggggatcccactcttctaca

SEQ ID NO: 57379 - DNA, 20 bp, Artificial Sequence
  sgRNA
  Slc6a4_18
gtccgaggtggccaaagacg

SEQ ID NO: 57380 - DNA, 20 bp, Artificial Sequence
  sgRNA
  Slc6a4_19
gcccaagatgatactccagt

SEQ ID NO: 57381 - DNA, 20 bp, Artificial Sequence
  sgRNA
  Slc6a4_20
tatcactcctgaaacaccaa

SEQ ID NO: 57382 - DNA, 20 bp, Artificial Sequence
  sgRNA
  Slc6a5_1
gggatggtcaccgataacac

SEQ ID NO: 57383 - DNA, 20 bp, Artificial Sequence
  sgRNA
  Slc6a5_2
gtgtacgcatcactggcgaa

SEQ ID NO: 57384 - DNA, 20 bp, Artificial Sequence
  sgRNA
  Slc6a5_3
gcttaccggtatggtagtgg

SEQ ID NO: 57385 - DNA, 20 bp, Artificial Sequence
  sgRNA
  Slc6a5_4
gaggacgcgaacgtgagtgt

SEQ ID NO: 57386 - DNA, 20 bp, Artificial Sequence
  sgRNA
  Slc6a5_5
attcttagctcagcaccgcg

SEQ ID NO: 57387 - DNA, 20 bp, Artificial Sequence
  sgRNA
  Slc6a5_6
gtgccagcatcatcaagtaa

SEQ ID NO: 57388 - DNA, 20 bp, Artificial Sequence
  sgRNA
  Slc6a5_7
gggatgagaataaggcccga

SEQ ID NO: 57389 - DNA, 20 bp, Artificial Sequence
  sgRNA
  Slc6a5_8
gtgcacgaggactatcccgg

SEQ ID NO: 57390 - DNA, 20 bp, Artificial Sequence
  sgRNA
  Slc6a5_9
tattcttgtagcgttccccg

SEQ ID NO: 57391 - DNA, 20 bp, Artificial Sequence
  sgRNA
  Slc6a5_10
ccagcgacgaagttcccaag

SEQ ID NO: 57392 - DNA, 20 bp, Artificial Sequence
  sgRNA
  Slc6a5_11
gcttaagtcccggagggccg

SEQ ID NO: 57393 - DNA, 20 bp, Artificial Sequence
  sgRNA
  Slc6a5_12
gagcaccgacgcgatgccat

SEQ ID NO: 57394 - DNA, 20 bp, Artificial Sequence
  sgRNA
  Slc6a5_13
gctcatattcacccagccca

SEQ ID NO: 57395 - DNA, 20 bp, Artificial Sequence
  sgRNA
  Slc6a5_14
ggatgaccaggacgacataa

SEQ ID NO: 57396 - DNA, 20 bp, Artificial Sequence
  sgRNA
  Slc6a5_15
gcacaacaataccccagccg

SEQ ID NO: 57397 - DNA, 20 bp, Artificial Sequence
  sgRNA
  Slc6a5_16
gggaaccgatggcatcgcgt

SEQ ID NO: 57398 - DNA, 20 bp, Artificial Sequence
  sgRNA
  Slc6a5_17
gggttgttgcaggaccccca

SEQ ID NO: 57399 - DNA, 20 bp, Artificial Sequence
  sgRNA
  Slc6a5_18
tacctggccttccagaacgg

SEQ ID NO: 57400 - DNA, 20 bp, Artificial Sequence
  sgRNA
  Slc6a5_19
gggtgactcctcgaataagg

SEQ ID NO: 57401 - DNA, 20 bp, Artificial Sequence
  sgRNA
  Slc6a5_20
gtgccactagcatctttgct

SEQ ID NO: 57402 - DNA, 20 bp, Artificial Sequence
  sgRNA
  Slc6a6_1
ggcccccaggcagattgcgt

SEQ ID NO: 57403 - DNA, 20 bp, Artificial Sequence
  sgRNA
  Slc6a6_2
ggccagtacacatcagaagg

SEQ ID NO: 57404 - DNA, 20 bp, Artificial Sequence
  sgRNA
  Slc6a6_3
aaacagaatagaccaaaagg

SEQ ID NO: 57405 - DNA, 20 bp, Artificial Sequence
  sgRNA
  Slc6a6_4
catggcaaacgggaaagtag

SEQ ID NO: 57406 - DNA, 20 bp, Artificial Sequence
  sgRNA
  Slc6a6_5
gtgactctcgttcctacgca

SEQ ID NO: 57407 - DNA, 20 bp, Artificial Sequence
  sgRNA
  Slc6a6_6
gatgtagtacacgttcagga

SEQ ID NO: 57408 - DNA, 20 bp, Artificial Sequence
  sgRNA
  Slc6a6_7
ctaagaggaggcagagcgcg

SEQ ID NO: 57409 - DNA, 20 bp, Artificial Sequence
  sgRNA
  Slc6a6_8
gcccagctgtacttcatcca

SEQ ID NO: 57410 - DNA, 20 bp, Artificial Sequence
  sgRNA
  Slc6a6_9
gtaccggtacactttgttgt

SEQ ID NO: 57411 - DNA, 20 bp, Artificial Sequence
  sgRNA
  Slc6a6_10
caaatacctgataaccccca

SEQ ID NO: 57412 - DNA, 20 bp, Artificial Sequence
  sgRNA
  Slc6a6_11
catgagtgcgccgttcatga

SEQ ID NO: 57413 - DNA, 20 bp, Artificial Sequence
  sgRNA
  Slc6a6_12
tgacctacaacaaagtgtac

SEQ ID NO: 57414 - DNA, 20 bp, Artificial Sequence
  sgRNA
  Slc6a6_13
tcccgagtaaccctcatgaa

SEQ ID NO: 57415 - DNA, 20 bp, Artificial Sequence
  sgRNA
  Slc6a6_14
ctgctgggatgcctgaacag

SEQ ID NO: 57416 - DNA, 20 bp, Artificial Sequence
  sgRNA
  Slc6a6_15
gcttcatggcacaagagcaa

SEQ ID NO: 57417 - DNA, 20 bp, Artificial Sequence
  sgRNA
  Slc6a6_16
cgatgtagtacacgttcagg

SEQ ID NO: 57418 - DNA, 20 bp, Artificial Sequence
  sgRNA
  Slc6a6_17
ggacgggtaaagatcaacca

SEQ ID NO: 57419 - DNA, 20 bp, Artificial Sequence
  sgRNA
  Slc6a6_18
tacccgtccttcctaaggaa

SEQ ID NO: 57420 - DNA, 20 bp, Artificial Sequence
  sgRNA
  Slc6a6_19
tcaccatcgtcagccccagc

SEQ ID NO: 57421 - DNA, 20 bp, Artificial Sequence
  sgRNA
  Slc6a6_20
ggctgtccagtccaagcaag

SEQ ID NO: 57422 - DNA, 20 bp, Artificial Sequence
  sgRNA
  Slc6a7_1
tccagcgaatctcccccggt

SEQ ID NO: 57423 - DNA, 20 bp, Artificial Sequence
  sgRNA
  Slc6a7_2
tcacctttgaagataacagg

SEQ ID NO: 57424 - DNA, 20 bp, Artificial Sequence
  sgRNA
  Slc6a7_3
gtagacttcgcagcagacag

SEQ ID NO: 57425 - DNA, 20 bp, Artificial Sequence
  sgRNA
  Slc6a7_4
taccgagcctacaccaatgg

SEQ ID NO: 57426 - DNA, 20 bp, Artificial Sequence
  sgRNA
  Slc6a7_5
tcgaggagtgacccttcccg

SEQ ID NO: 57427 - DNA, 20 bp, Artificial Sequence
  sgRNA
  Slc6a7_6
cgatagctgccatattctga

SEQ ID NO: 57428 - DNA, 20 bp, Artificial Sequence
  sgRNA
  Slc6a7_7
ggtggaccgtgagatcgcag

SEQ ID NO: 57429 - DNA, 20 bp, Artificial Sequence
  sgRNA
  Slc6a7_8
tcttgcctcatgatcccagc

SEQ ID NO: 57430 - DNA, 20 bp, Artificial Sequence
  sgRNA
  Slc6a7_9
atctctggaagagaaccgga

SEQ ID NO: 57431 - DNA, 20 bp, Artificial Sequence
  sgRNA
  Slc6a7_10
ggatatctcggcagaaccgc

SEQ ID NO: 57432 - DNA, 20 bp, Artificial Sequence
  sgRNA
  Slc6a7_11
tggcgctgtagtcatccaaa

SEQ ID NO: 57433 - DNA, 20 bp, Artificial Sequence
  sgRNA
  Slc6a7_12
ggtacacatgcgcaaatacg

SEQ ID NO: 57434 - DNA, 20 bp, Artificial Sequence
  sgRNA
  Slc6a7_13
gtagctgtgcttcgagagga

SEQ ID NO: 57435 - DNA, 20 bp, Artificial Sequence
  sgRNA
  Slc6a7_14
aggttccagcgaatctcccc

SEQ ID NO: 57436 - DNA, 20 bp, Artificial Sequence
  sgRNA
  Slc6a7_15
gatctcacggtccacctcaa

SEQ ID NO: 57437 - DNA, 20 bp, Artificial Sequence
  sgRNA
  Slc6a7_16
gtacacatgcgcaaatacgg

SEQ ID NO: 57438 - DNA, 20 bp, Artificial Sequence
  sgRNA
  Slc6a7_17
gcatgaggaagtagggcacg

SEQ ID NO: 57439 - DNA, 20 bp, Artificial Sequence
  sgRNA
  Slc6a7_18
catccaggtccacatcgccc

SEQ ID NO: 57440 - DNA, 20 bp, Artificial Sequence
  sgRNA
  Slc6a7_19
tcctgcatcggctactgcgt

SEQ ID NO: 57441 - DNA, 20 bp, Artificial Sequence
  sgRNA
  Slc6a7_20
gggtgtgcccgtggaccaag

SEQ ID NO: 57442 - DNA, 20 bp, Artificial Sequence
  sgRNA
  Slc6a8_1
ggaagcgccacacgttaccg

SEQ ID NO: 57443 - DNA, 20 bp, Artificial Sequence
  sgRNA
  Slc6a8_2
gcatcagtgtgacagcccgt

SEQ ID NO: 57444 - DNA, 20 bp, Artificial Sequence
  sgRNA
  Slc6a8_3
gcacaacgaggaccacgtag

SEQ ID NO: 57445 - DNA, 20 bp, Artificial Sequence
  sgRNA
  Slc6a8_4
actcgatgacaggggaccgg

SEQ ID NO: 57446 - DNA, 20 bp, Artificial Sequence
  sgRNA
  Slc6a8_5
aagtattgaggctctccacg

SEQ ID NO: 57447 - DNA, 20 bp, Artificial Sequence
  sgRNA
  Slc6a8_6
cattggcacagtcttcatgg

SEQ ID NO: 57448 - DNA, 20 bp, Artificial Sequence
  sgRNA
  Slc6a8_7
agcctgactggtcaaagcta

SEQ ID NO: 57449 - DNA, 20 bp, Artificial Sequence
  sgRNA
  Slc6a8_8
ctcatcgtgtccgggcccga

SEQ ID NO: 57450 - DNA, 20 bp, Artificial Sequence
  sgRNA
  Slc6a8_9
cctttactaccactttgcca

SEQ ID NO: 57451 - DNA, 20 bp, Artificial Sequence
  sgRNA
  Slc6a8_10
aggtcggtacccaatcatac

SEQ ID NO: 57452 - DNA, 20 bp, Artificial Sequence
  sgRNA
  Slc6a8_11
cgtgtccaagtctctcgcgg

SEQ ID NO: 57453 - DNA, 20 bp, Artificial Sequence
  sgRNA
  Slc6a8_12
ttggaaacggaagtagtagg

SEQ ID NO: 57454 - DNA, 20 bp, Artificial Sequence
  sgRNA
  Slc6a8_13
tcgggcccggacacgatgag

SEQ ID NO: 57455 - DNA, 20 bp, Artificial Sequence
  sgRNA
  Slc6a8_14
ctcgcggtggcactgcaagg

SEQ ID NO: 57456 - DNA, 20 bp, Artificial Sequence
  sgRNA
  Slc6a8_15
aatggggattcctccaacca

SEQ ID NO: 57457 - DNA, 20 bp, Artificial Sequence
  sgRNA
  Slc6a8_16
gacttcatcatgtcgtgcgt

SEQ ID NO: 57458 - DNA, 20 bp, Artificial Sequence
  sgRNA
  Slc6a8_17
gggtgtgcatatctccaagg

SEQ ID NO: 57459 - DNA, 20 bp, Artificial Sequence
  sgRNA
  Slc6a8_18
gtgtctggtgacgagaagaa

SEQ ID NO: 57460 - DNA, 20 bp, Artificial Sequence
  sgRNA
  Slc6a8_19
ctactacttccgtttccaaa

SEQ ID NO: 57461 - DNA, 20 bp, Artificial Sequence
  sgRNA
  Slc6a8_20
cggagatctccctttggaaa

SEQ ID NO: 57462 - DNA, 20 bp, Artificial Sequence
  sgRNA
  Slc6a9_1
atacctctgctatcgcaacg

SEQ ID NO: 57463 - DNA, 20 bp, Artificial Sequence
  sgRNA
  Slc6a9_2
gtagtacatgatacccgtga

SEQ ID NO: 57464 - DNA, 20 bp, Artificial Sequence
  sgRNA
  Slc6a9_3
atggtggtgtccacatacat

SEQ ID NO: 57465 - DNA, 20 bp, Artificial Sequence
  sgRNA
  Slc6a9_4
tgtgctaccagcgtctacgc

SEQ ID NO: 57466 - DNA, 20 bp, Artificial Sequence
  sgRNA
  Slc6a9_5
tgacagacgacaaagccatg

SEQ ID NO: 57467 - DNA, 20 bp, Artificial Sequence
  sgRNA
  Slc6a9_6
gggttgttgcagtacgccca

SEQ ID NO: 57468 - DNA, 20 bp, Artificial Sequence
  sgRNA
  Slc6a9_7
gagccgttactgcccacgat

SEQ ID NO: 57469 - DNA, 20 bp, Artificial Sequence
  sgRNA
  Slc6a9_8
cagtgaccagggtctctagg

SEQ ID NO: 57470 - DNA, 20 bp, Artificial Sequence
  sgRNA
  Slc6a9_9
gacgagcgtgggctatgccg

SEQ ID NO: 57471 - DNA, 20 bp, Artificial Sequence
  sgRNA
  Slc6a9_10
gatacaggagatgacaacca

SEQ ID NO: 57472 - DNA, 20 bp, Artificial Sequence
  sgRNA
  Slc6a9_11
gtactacctgaccccacaat

SEQ ID NO: 57473 - DNA, 20 bp, Artificial Sequence
  sgRNA
  Slc6a9_12
gctggaacagcgcgtacagt

SEQ ID NO: 57474 - DNA, 20 bp, Artificial Sequence
  sgRNA
  Slc6a9_13
tctcagatcttctattccct

SEQ ID NO: 57475 - DNA, 20 bp, Artificial Sequence
  sgRNA
  Slc6a9_14
ctcccccgttgcgatagcag

SEQ ID NO: 57476 - DNA, 20 bp, Artificial Sequence
  sgRNA
  Slc6a9_15
gctgggctatgagttaggac

SEQ ID NO: 57477 - DNA, 20 bp, Artificial Sequence
  sgRNA
  Slc6a9_16
cattggcatctactacaacg

SEQ ID NO: 57478 - DNA, 20 bp, Artificial Sequence
  sgRNA
  Slc6a9_17
gagtttgtactgacgagcgt

SEQ ID NO: 57479 - DNA, 20 bp, Artificial Sequence
  sgRNA
  Slc6a9_18
caaccacccaggagacgccg

SEQ ID NO: 57480 - DNA, 20 bp, Artificial Sequence
  sgRNA
  Slc6a9_19
tcgtcagtacaaactcgatc

SEQ ID NO: 57481 - DNA, 20 bp, Artificial Sequence
  sgRNA
  Slc6a9_20
ctatgcagccagcttctcct

SEQ ID NO: 57482 - DNA, 20 bp, Artificial Sequence
  sgRNA
  Slc7a1_1
gccatggcatagataactcg

SEQ ID NO: 57483 - DNA, 20 bp, Artificial Sequence
  sgRNA
  Slc7a1_2
cacaaacgtgaaatacggtg

SEQ ID NO: 57484 - DNA, 20 bp, Artificial Sequence
  sgRNA
  Slc7a1_3
tgacgtgagaactctccgat

SEQ ID NO: 57485 - DNA, 20 bp, Artificial Sequence
  sgRNA
  Slc7a1_4
ccaggtccttcagttcaaag

SEQ ID NO: 57486 - DNA, 20 bp, Artificial Sequence
  sgRNA
  Slc7a1_5
cctggtgccttcaagcacca

SEQ ID NO: 57487 - DNA, 20 bp, Artificial Sequence
  sgRNA
  Slc7a1_6
ccagatggccagaaccaccg

SEQ ID NO: 57488 - DNA, 20 bp, Artificial Sequence
  sgRNA
  Slc7a1_7
aggacaccagagaatccaaa

SEQ ID NO: 57489 - DNA, 20 bp, Artificial Sequence
  sgRNA
  Slc7a1_8
ctatgtcctagccggtgccg

SEQ ID NO: 57490 - DNA, 20 bp, Artificial Sequence
  sgRNA
  Slc7a1_9
tactcgatctagctcctcgg

SEQ ID NO: 57491 - DNA, 20 bp, Artificial Sequence
  sgRNA
  Slc7a1_10
acctaatctggtataccaga

SEQ ID NO: 57492 - DNA, 20 bp, Artificial Sequence
  sgRNA
  Slc7a1_11
agagttctcacgtcagcaca

SEQ ID NO: 57493 - DNA, 20 bp, Artificial Sequence
  sgRNA
  Slc7a1_12
gcagctggaccagggcacgt

SEQ ID NO: 57494 - DNA, 20 bp, Artificial Sequence
  sgRNA
  Slc7a1_13
gccccgagttatctatgcca

SEQ ID NO: 57495 - DNA, 20 bp, Artificial Sequence
  sgRNA
  Slc7a1_14
gctggtgtctatgtcctagc

SEQ ID NO: 57496 - DNA, 20 bp, Artificial Sequence
  sgRNA
  Slc7a1_15
ctaattgtgaacatttcagc

SEQ ID NO: 57497 - DNA, 20 bp, Artificial Sequence
  sgRNA
  Slc7a1_16
tggcgtgaaggagtcagcca

SEQ ID NO: 57498 - DNA, 20 bp, Artificial Sequence
  sgRNA
  Slc7a1_17
gcacacggtgatgataagag

SEQ ID NO: 57499 - DNA, 20 bp, Artificial Sequence
  sgRNA
  Slc7a1_18
ctttgaactgaaggacctgg

SEQ ID NO: 57500 - DNA, 20 bp, Artificial Sequence
  sgRNA
  Slc7a1_19
gatcccataaccgaaataga

SEQ ID NO: 57501 - DNA, 20 bp, Artificial Sequence
  sgRNA
  Slc7a1_20
ctgattctctcctacatcat

SEQ ID NO: 57502 - DNA, 20 bp, Artificial Sequence
  sgRNA
  Slc7a10_1
gtgtacacaaaggtgaccag

SEQ ID NO: 57503 - DNA, 20 bp, Artificial Sequence
  sgRNA
  Slc7a10_2
tgatccctccaaaagtagag

SEQ ID NO: 57504 - DNA, 20 bp, Artificial Sequence
  sgRNA
  Slc7a10_3
tgagccaatgatgttccctg

SEQ ID NO: 57505 - DNA, 20 bp, Artificial Sequence
  sgRNA
  Slc7a10_4
ggccatggagagtactcgag

SEQ ID NO: 57506 - DNA, 20 bp, Artificial Sequence
  sgRNA
  Slc7a10_5
ggatagtgactccgtagcag

SEQ ID NO: 57507 - DNA, 20 bp, Artificial Sequence
  sgRNA
  Slc7a10_6
acagcggtcatcatgctcgt

SEQ ID NO: 57508 - DNA, 20 bp, Artificial Sequence
  sgRNA
  Slc7a10_7
cttgagtgccacccgctccg

SEQ ID NO: 57509 - DNA, 20 bp, Artificial Sequence
  sgRNA
  Slc7a10_8
gctgtcctccaacgccgtgg

SEQ ID NO: 57510 - DNA, 20 bp, Artificial Sequence
  sgRNA
  Slc7a10_9
gatccctccaaaagtagaga

SEQ ID NO: 57511 - DNA, 20 bp, Artificial Sequence
  sgRNA
  Slc7a10_10
gaagataacctggatgcgcg

SEQ ID NO: 57512 - DNA, 20 bp, Artificial Sequence
  sgRNA
  Slc7a10_11
tatgtcactgagatcttcgg

SEQ ID NO: 57513 - DNA, 20 bp, Artificial Sequence
  sgRNA
  Slc7a10_12
gacgaagagggccaaaccca

SEQ ID NO: 57514 - DNA, 20 bp, Artificial Sequence
  sgRNA
  Slc7a10_13
gctcctccgtgacatagttg

SEQ ID NO: 57515 - DNA, 20 bp, Artificial Sequence
  sgRNA
  Slc7a10_14
agaaccttggaggaaagcca

SEQ ID NO: 57516 - DNA, 20 bp, Artificial Sequence
  sgRNA
  Slc7a10_15
tgtacacaaaggtgaccagt

SEQ ID NO: 57517 - DNA, 20 bp, Artificial Sequence
  sgRNA
  Slc7a10_16
ggtgttctgggcattcctac

SEQ ID NO: 57518 - DNA, 20 bp, Artificial Sequence
  sgRNA
  Slc7a10_17
cgtagtccccaccagacttg

SEQ ID NO: 57519 - DNA, 20 bp, Artificial Sequence
  sgRNA
  Slc7a10_18
cttcctcaactatgtcacgg

SEQ ID NO: 57520 - DNA, 20 bp, Artificial Sequence
  sgRNA
  Slc7a10_19
gtctgacatgaatcatggcc

SEQ ID NO: 57521 - DNA, 20 bp, Artificial Sequence
  sgRNA
  Slc7a10_20
gtggcactcaagaaagagat

SEQ ID NO: 57522 - DNA, 20 bp, Artificial Sequence
  sgRNA
  Slc7a14_1
aaatgccacgaactccccaa

SEQ ID NO: 57523 - DNA, 20 bp, Artificial Sequence
  sgRNA
  Slc7a14_2
gggatgccgtgatggcgtaa

SEQ ID NO: 57524 - DNA, 20 bp, Artificial Sequence
  sgRNA
  Slc7a14_3
cttcgcagcatagaagccat

SEQ ID NO: 57525 - DNA, 20 bp, Artificial Sequence
  sgRNA
  Slc7a14_4
tctgggagtgaaaaactctg

SEQ ID NO: 57526 - DNA, 20 bp, Artificial Sequence
  sgRNA
  Slc7a14_5
tagcttggtaccatgcgccg

SEQ ID NO: 57527 - DNA, 20 bp, Artificial Sequence
  sgRNA
  Slc7a14_6
gatcctgcgcaccaaaccag

SEQ ID NO: 57528 - DNA, 20 bp, Artificial Sequence
  sgRNA
  Slc7a14_7
gcatcatcagaacgaccaga

SEQ ID NO: 57529 - DNA, 20 bp, Artificial Sequence
  sgRNA
  Slc7a14_8
agagtgcattgcataccagg

SEQ ID NO: 57530 - DNA, 20 bp, Artificial Sequence
  sgRNA
  Slc7a14_9
ctacaccatgagaatccggc

SEQ ID NO: 57531 - DNA, 20 bp, Artificial Sequence
  sgRNA
  Slc7a14_10
ccacggtgtccaccatccag

SEQ ID NO: 57532 - DNA, 20 bp, Artificial Sequence
  sgRNA
  Slc7a14_11
gccatggcgtaaatgaccct

SEQ ID NO: 57533 - DNA, 20 bp, Artificial Sequence
  sgRNA
  Slc7a14_12
cctacagctatgtcaccgtt

SEQ ID NO: 57534 - DNA, 20 bp, Artificial Sequence
  sgRNA
  Slc7a14_13
ttcatcggcttctatgcccg

SEQ ID NO: 57535 - DNA, 20 bp, Artificial Sequence
  sgRNA
  Slc7a14_14
tttacgccatggctggcgat

SEQ ID NO: 57536 - DNA, 20 bp, Artificial Sequence
  sgRNA
  Slc7a14_15
attctcatggtgtagtaacg

SEQ ID NO: 57537 - DNA, 20 bp, Artificial Sequence
  sgRNA
  Slc7a14_16
ggggttctcctacgccaccg

SEQ ID NO: 57538 - DNA, 20 bp, Artificial Sequence
  sgRNA
  Slc7a14_17
cgatggacatcatctctatg

SEQ ID NO: 57539 - DNA, 20 bp, Artificial Sequence
  sgRNA
  Slc7a14_18
gcatggtaccaagctagccc

SEQ ID NO: 57540 - DNA, 20 bp, Artificial Sequence
  sgRNA
  Slc7a14_19
gaaggccagttcttgcccca

SEQ ID NO: 57541 - DNA, 20 bp, Artificial Sequence
  sgRNA
  Slc7a14_20
cagatgcgaaggcaaacagc

SEQ ID NO: 57542 - DNA, 20 bp, Artificial Sequence
  sgRNA
  Slc7a2_1
aggacgtcactattccgatg

SEQ ID NO: 57543 - DNA, 20 bp, Artificial Sequence
  sgRNA
  Slc7a2_2
gaacggaacaagcatctacg

SEQ ID NO: 57544 - DNA, 20 bp, Artificial Sequence
  sgRNA
  Slc7a2_3
gtatctatacacttacgtca

SEQ ID NO: 57545 - DNA, 20 bp, Artificial Sequence
  sgRNA
  Slc7a2_4
ccgagacaacatatttggcg

SEQ ID NO: 57546 - DNA, 20 bp, Artificial Sequence
  sgRNA
  Slc7a2_5
gcaaaggccggccataaccg

SEQ ID NO: 57547 - DNA, 20 bp, Artificial Sequence
  sgRNA
  Slc7a2_6
ctatacacttacgtcacggt

SEQ ID NO: 57548 - DNA, 20 bp, Artificial Sequence
  sgRNA
  Slc7a2_7
aatggcctggacgccatacg

SEQ ID NO: 57549 - DNA, 20 bp, Artificial Sequence
  sgRNA
  Slc7a2_8
aaggacgtcactattccgat

SEQ ID NO: 57550 - DNA, 20 bp, Artificial Sequence
  sgRNA
  Slc7a2_9
ggtccacggtggttaagcag

SEQ ID NO: 57551 - DNA, 20 bp, Artificial Sequence
  sgRNA
  Slc7a2_10
aatagacatcatgtccacga

SEQ ID NO: 57552 - DNA, 20 bp, Artificial Sequence
  sgRNA
  Slc7a2_11
tgtaatctatgctatggcgg

SEQ ID NO: 57553 - DNA, 20 bp, Artificial Sequence
  sgRNA
  Slc7a2_12
gccatagcatagattacacg

SEQ ID NO: 57554 - DNA, 20 bp, Artificial Sequence
  sgRNA
  Slc7a2_13
aacgtccctgtaaagccata

SEQ ID NO: 57555 - DNA, 20 bp, Artificial Sequence
  sgRNA
  Slc7a2_14
gccatggcaaacagaattcg

SEQ ID NO: 57556 - DNA, 20 bp, Artificial Sequence
  sgRNA
  Slc7a2_15
ctgccgctgcttaaccaccg

SEQ ID NO: 57557 - DNA, 20 bp, Artificial Sequence
  sgRNA
  Slc7a2_16
ggtggaagagagcaacctgt

SEQ ID NO: 57558 - DNA, 20 bp, Artificial Sequence
  sgRNA
  Slc7a2_17
caaagcgatgaggtccacgg

SEQ ID NO: 57559 - DNA, 20 bp, Artificial Sequence
  sgRNA
  Slc7a2_18
tggttagaatactcaagccc

SEQ ID NO: 57560 - DNA, 20 bp, Artificial Sequence
  sgRNA
  Slc7a2_19
ggaaagacaccacgatactc

SEQ ID NO: 57561 - DNA, 20 bp, Artificial Sequence
  sgRNA
  Slc7a2_20
tgacatactcaaacgcgacc

SEQ ID NO: 57562 - DNA, 20 bp, Artificial Sequence
  sgRNA
  Slc7a3_1
atctatctcaccaatgacgt

SEQ ID NO: 57563 - DNA, 20 bp, Artificial Sequence
  sgRNA
  Slc7a3_2
gccattgaatacatcacccg

SEQ ID NO: 57564 - DNA, 20 bp, Artificial Sequence
  sgRNA
  Slc7a3_3
cacccagagccactaagtcg

SEQ ID NO: 57565 - DNA, 20 bp, Artificial Sequence
  sgRNA
  Slc7a3_4
agtgccgttggattcactca

SEQ ID NO: 57566 - DNA, 20 bp, Artificial Sequence
  sgRNA
  Slc7a3_5
gatatgcagaaccagagccg

SEQ ID NO: 57567 - DNA, 20 bp, Artificial Sequence
  sgRNA
  Slc7a3_6
cgattgacatgaggtccacg

SEQ ID NO: 57568 - DNA, 20 bp, Artificial Sequence
  sgRNA
  Slc7a3_7
gcctcgggtgatgtattcaa

SEQ ID NO: 57569 - DNA, 20 bp, Artificial Sequence
  sgRNA
  Slc7a3_8
aatacagtcaaaaccaacga

SEQ ID NO: 57570 - DNA, 20 bp, Artificial Sequence
  sgRNA
  Slc7a3_9
tgtgaacactttggtaacca

SEQ ID NO: 57571 - DNA, 20 bp, Artificial Sequence
  sgRNA
  Slc7a3_10
gaaggcccagagttcaccta

SEQ ID NO: 57572 - DNA, 20 bp, Artificial Sequence
  sgRNA
  Slc7a3_11
tcgagatcacaatacccatg

SEQ ID NO: 57573 - DNA, 20 bp, Artificial Sequence
  sgRNA
  Slc7a3_12
gaatacatcacccgaggcat

SEQ ID NO: 57574 - DNA, 20 bp, Artificial Sequence
  sgRNA
  Slc7a3_13
tcaaactctacccaaaacaa

SEQ ID NO: 57575 - DNA, 20 bp, Artificial Sequence
  sgRNA
  Slc7a3_14
tctgggccttcaccaccggc

SEQ ID NO: 57576 - DNA, 20 bp, Artificial Sequence
  sgRNA
  Slc7a3_15
ggagcctgcccgctacttgg

SEQ ID NO: 57577 - DNA, 20 bp, Artificial Sequence
  sgRNA
  Slc7a3_16
gataccaaggtggccacaat

SEQ ID NO: 57578 - DNA, 20 bp, Artificial Sequence
  sgRNA
  Slc7a3_17
agaatcccttccaagccaaa

SEQ ID NO: 57579 - DNA, 20 bp, Artificial Sequence
  sgRNA
  Slc7a3_18
actcggccagaaaggagtgt

SEQ ID NO: 57580 - DNA, 20 bp, Artificial Sequence
  sgRNA
  Slc7a3_19
atcgagatcacaatacccat

SEQ ID NO: 57581 - DNA, 20 bp, Artificial Sequence
  sgRNA
  Slc7a3_20
tgctgttcctctactcccac

SEQ ID NO: 57582 - DNA, 20 bp, Artificial Sequence
  sgRNA
  Slc7a4_1
aggtatgctgagccagtacg

SEQ ID NO: 57583 - DNA, 20 bp, Artificial Sequence
  sgRNA
  Slc7a4_2
gcacagcctagaccctgact

SEQ ID NO: 57584 - DNA, 20 bp, Artificial Sequence
  sgRNA
  Slc7a4_3
aataacatcaaatcccacga

SEQ ID NO: 57585 - DNA, 20 bp, Artificial Sequence
  sgRNA
  Slc7a4_4
gccatggcgtagacaatgcg

SEQ ID NO: 57586 - DNA, 20 bp, Artificial Sequence
  sgRNA
  Slc7a4_5
tctacgccatggctgccgat

SEQ ID NO: 57587 - DNA, 20 bp, Artificial Sequence
  sgRNA
  Slc7a4_6
cactacgtggtattccccag

SEQ ID NO: 57588 - DNA, 20 bp, Artificial Sequence
  sgRNA
  Slc7a4_7
aggatgccagagaagccgaa

SEQ ID NO: 57589 - DNA, 20 bp, Artificial Sequence
  sgRNA
  Slc7a4_8
gccgcgcattgtctacgcca

SEQ ID NO: 57590 - DNA, 20 bp, Artificial Sequence
  sgRNA
  Slc7a4_9
gctgatgctttctacaggcg

SEQ ID NO: 57591 - DNA, 20 bp, Artificial Sequence
  sgRNA
  Slc7a4_10
cggactggtgattgactaga

SEQ ID NO: 57592 - DNA, 20 bp, Artificial Sequence
  sgRNA
  Slc7a4_11
atgcagccctggaaccgccg

SEQ ID NO: 57593 - DNA, 20 bp, Artificial Sequence
  sgRNA
  Slc7a4_12
ctacaggcggggttacagct

SEQ ID NO: 57594 - DNA, 20 bp, Artificial Sequence
  sgRNA
  Slc7a4_13
gaacgtgtgattaagccagg

SEQ ID NO: 57595 - DNA, 20 bp, Artificial Sequence
  sgRNA
  Slc7a4_14
gtacaacctgactcccggac

SEQ ID NO: 57596 - DNA, 20 bp, Artificial Sequence
  sgRNA
  Slc7a4_15
gtgaggaggccaaaaaccca

SEQ ID NO: 57597 - DNA, 20 bp, Artificial Sequence
  sgRNA
  Slc7a4_16
tttgctgctgatgagccccc

SEQ ID NO: 57598 - DNA, 20 bp, Artificial Sequence
  sgRNA
  Slc7a4_17
ttgctgatgctttctacagg

SEQ ID NO: 57599 - DNA, 20 bp, Artificial Sequence
  sgRNA
  Slc7a4_18
agccacgagtaaaatgccag

SEQ ID NO: 57600 - DNA, 20 bp, Artificial Sequence
  sgRNA
  Slc7a4_19
gatgccaagcgcccaggcca

SEQ ID NO: 57601 - DNA, 20 bp, Artificial Sequence
  sgRNA
  Slc7a4_20
gtttcctccaggctaccgct

SEQ ID NO: 57602 - DNA, 20 bp, Artificial Sequence
  sgRNA
  Slc7a5_1
gccctcctcgcagtacatcg

SEQ ID NO: 57603 - DNA, 20 bp, Artificial Sequence
  sgRNA
  Slc7a5_2
acccctacttacgcacgcag

SEQ ID NO: 57604 - DNA, 20 bp, Artificial Sequence
  sgRNA
  Slc7a5_3
agcggcctcttcgcctacgg

SEQ ID NO: 57605 - DNA, 20 bp, Artificial Sequence
  sgRNA
  Slc7a5_4
gtagcagagtgcgcccacga

SEQ ID NO: 57606 - DNA, 20 bp, Artificial Sequence
  sgRNA
  Slc7a5_5
gcttccttgagcacgccggt

SEQ ID NO: 57607 - DNA, 20 bp, Artificial Sequence
  sgRNA
  Slc7a5_6
ccggcgtgctcaaggaagcg

SEQ ID NO: 57608 - DNA, 20 bp, Artificial Sequence
  sgRNA
  Slc7a5_7
cagcgccacgatgtactgcg

SEQ ID NO: 57609 - DNA, 20 bp, Artificial Sequence
  sgRNA
  Slc7a5_8
gcttcgccatcatcctcagc

SEQ ID NO: 57610 - DNA, 20 bp, Artificial Sequence
  sgRNA
  Slc7a5_9
aagccaatgccacactccat

SEQ ID NO: 57611 - DNA, 20 bp, Artificial Sequence
  sgRNA
  Slc7a5_10
cgcaatatcacgctgctcaa

SEQ ID NO: 57612 - DNA, 20 bp, Artificial Sequence
  sgRNA
  Slc7a5_11
cgactacgcctacatgctgg

SEQ ID NO: 57613 - DNA, 20 bp, Artificial Sequence
  sgRNA
  Slc7a5_12
gctctgccagaagttgatgc

SEQ ID NO: 57614 - DNA, 20 bp, Artificial Sequence
  sgRNA
  Slc7a5_13
ggacttcgggaactaccact

SEQ ID NO: 57615 - DNA, 20 bp, Artificial Sequence
  sgRNA
  Slc7a5_14
catcataccgatgatggcca

SEQ ID NO: 57616 - DNA, 20 bp, Artificial Sequence
  sgRNA
  Slc7a5_15
aagatgttggaggcgcggcg

SEQ ID NO: 57617 - DNA, 20 bp, Artificial Sequence
  sgRNA
  Slc7a5_16
tctacttctttggtgtctgg

SEQ ID NO: 57618 - DNA, 20 bp, Artificial Sequence
  sgRNA
  Slc7a5_17
tccaggacatgacacccaag

SEQ ID NO: 57619 - DNA, 20 bp, Artificial Sequence
  sgRNA
  Slc7a5_18
acatagaccagtgtgacaat

SEQ ID NO: 57620 - DNA, 20 bp, Artificial Sequence
  sgRNA
  Slc7a5_19
gtcattctggaagacaccca

SEQ ID NO: 57621 - DNA, 20 bp, Artificial Sequence
  sgRNA
  Slc7a5_20
ggtggaagaacaagcccaag

SEQ ID NO: 57622 - DNA, 20 bp, Artificial Sequence
  sgRNA
  Slc7a6_1
gaggtctcccacattccacg

SEQ ID NO: 57623 - DNA, 20 bp, Artificial Sequence
  sgRNA
  Slc7a6_2
ggagatctccttgctgaacg

SEQ ID NO: 57624 - DNA, 20 bp, Artificial Sequence
  sgRNA
  Slc7a6_3
cactataagtgacaacccat

SEQ ID NO: 57625 - DNA, 20 bp, Artificial Sequence
  sgRNA
  Slc7a6_4
agacggcaggccacatatgg

SEQ ID NO: 57626 - DNA, 20 bp, Artificial Sequence
  sgRNA
  Slc7a6_5
tcatggacagaaggttcggg

SEQ ID NO: 57627 - DNA, 20 bp, Artificial Sequence
  sgRNA
  Slc7a6_6
atgccggctcaccatctcaa

SEQ ID NO: 57628 - DNA, 20 bp, Artificial Sequence
  sgRNA
  Slc7a6_7
acgcctttaaaggttcctcg

SEQ ID NO: 57629 - DNA, 20 bp, Artificial Sequence
  sgRNA
  Slc7a6_8
gagcagacgcagaacacgat

SEQ ID NO: 57630 - DNA, 20 bp, Artificial Sequence
  sgRNA
  Slc7a6_9
tcgtgtgccccacttgacgt

SEQ ID NO: 57631 - DNA, 20 bp, Artificial Sequence
  sgRNA
  Slc7a6_10
aattggcatagaaatcccaa

SEQ ID NO: 57632 - DNA, 20 bp, Artificial Sequence
  sgRNA
  Slc7a6_11
ttagaagtgagacccacaga

SEQ ID NO: 57633 - DNA, 20 bp, Artificial Sequence
  sgRNA
  Slc7a6_12
ggtgggctcttctctgtcgt

SEQ ID NO: 57634 - DNA, 20 bp, Artificial Sequence
  sgRNA
  Slc7a6_13
gctagcccctgatttggtga

SEQ ID NO: 57635 - DNA, 20 bp, Artificial Sequence
  sgRNA
  Slc7a6_14
tatattctagaggccttcgg

SEQ ID NO: 57636 - DNA, 20 bp, Artificial Sequence
  sgRNA
  Slc7a6_15
cttcagctactggttcttcg

SEQ ID NO: 57637 - DNA, 20 bp, Artificial Sequence
  sgRNA
  Slc7a6_16
tcaagtacactgcttcctat

SEQ ID NO: 57638 - DNA, 20 bp, Artificial Sequence
  sgRNA
  Slc7a6_17
caatcatgttgcccaccacc

SEQ ID NO: 57639 - DNA, 20 bp, Artificial Sequence
  sgRNA
  Slc7a6_18
catgacacttatctacctcg

SEQ ID NO: 57640 - DNA, 20 bp, Artificial Sequence
  sgRNA
  Slc7a6_19
ggaccaccatcaccaaatca

SEQ ID NO: 57641 - DNA, 20 bp, Artificial Sequence
  sgRNA
  Slc7a6_20
ggagggcttgatgatatagt

SEQ ID NO: 57642 - DNA, 20 bp, Artificial Sequence
  sgRNA
  Slc7a9_1
gagcacttaccaaccatcgt

SEQ ID NO: 57643 - DNA, 20 bp, Artificial Sequence
  sgRNA
  Slc7a9_2
caaaggcctccatcagatag

SEQ ID NO: 57644 - DNA, 20 bp, Artificial Sequence
  sgRNA
  Slc7a9_3
ggactgcaagagctccgttg

SEQ ID NO: 57645 - DNA, 20 bp, Artificial Sequence
  sgRNA
  Slc7a9_4
gctggccaacacagaatccg

SEQ ID NO: 57646 - DNA, 20 bp, Artificial Sequence
  sgRNA
  Slc7a9_5
tggccaacacagaatccgtg

SEQ ID NO: 57647 - DNA, 20 bp, Artificial Sequence
  sgRNA
  Slc7a9_6
cacacagtagagatactccc

SEQ ID NO: 57648 - DNA, 20 bp, Artificial Sequence
  sgRNA
  Slc7a9_7
gtacctgctttacagccggc

SEQ ID NO: 57649 - DNA, 20 bp, Artificial Sequence
  sgRNA
  Slc7a9_8
aatggactctgggcctacga

SEQ ID NO: 57650 - DNA, 20 bp, Artificial Sequence
  sgRNA
  Slc7a9_9
cagtgaatgcgctaagcgtg

SEQ ID NO: 57651 - DNA, 20 bp, Artificial Sequence
  sgRNA
  Slc7a9_10
gcggcccatatgatgagaca

SEQ ID NO: 57652 - DNA, 20 bp, Artificial Sequence
  sgRNA
  Slc7a9_11
gggtgagtacccctatctga

SEQ ID NO: 57653 - DNA, 20 bp, Artificial Sequence
  sgRNA
  Slc7a9_12
tatgatgagacagggcccca

SEQ ID NO: 57654 - DNA, 20 bp, Artificial Sequence
  sgRNA
  Slc7a9_13
gggcttcatgacgatcaggc

SEQ ID NO: 57655 - DNA, 20 bp, Artificial Sequence
  sgRNA
  Slc7a9_14
catcatttacatcatccctg

SEQ ID NO: 57656 - DNA, 20 bp, Artificial Sequence
  sgRNA
  Slc7a9_15
gctggtccaggagaagaggt

SEQ ID NO: 57657 - DNA, 20 bp, Artificial Sequence
  sgRNA
  Slc7a9_16
gctcactgatgattggagcc

SEQ ID NO: 57658 - DNA, 20 bp, Artificial Sequence
  sgRNA
  Slc7a9_17
aatggtacctgctttacagc

SEQ ID NO: 57659 - DNA, 20 bp, Artificial Sequence
  sgRNA
  Slc7a9_18
tgtagccaggattccacagg

SEQ ID NO: 57660 - DNA, 20 bp, Artificial Sequence
  sgRNA
  Slc7a9_19
tgtgtgttgttcatactgag

SEQ ID NO: 57661 - DNA, 20 bp, Artificial Sequence
  sgRNA
  Slc7a9_20
gttggccagcacagacttgg

SEQ ID NO: 57662 - DNA, 20 bp, Artificial Sequence
  sgRNA
  Slc8a1_1
ctgattatgaattcacggaa

SEQ ID NO: 57663 - DNA, 20 bp, Artificial Sequence
  sgRNA
  Slc8a1_2
aatcgcactctgtgtttacg

SEQ ID NO: 57664 - DNA, 20 bp, Artificial Sequence
  sgRNA
  Slc8a1_3
actcacgtgagcgagagcat

SEQ ID NO: 57665 - DNA, 20 bp, Artificial Sequence
  sgRNA
  Slc8a1_4
ctgcaataatagaaactcca

SEQ ID NO: 57666 - DNA, 20 bp, Artificial Sequence
  sgRNA
  Slc8a1_5
catctgcgttgtgttcgcgt

SEQ ID NO: 57667 - DNA, 20 bp, Artificial Sequence
  sgRNA
  Slc8a1_6
atcacgtaatcaaaacagga

SEQ ID NO: 57668 - DNA, 20 bp, Artificial Sequence
  sgRNA
  Slc8a1_7
gcggccataacttcaccgca

SEQ ID NO: 57669 - DNA, 20 bp, Artificial Sequence
  sgRNA
  Slc8a1_8
agtcaaggtaatcgatgacg

SEQ ID NO: 57670 - DNA, 20 bp, Artificial Sequence
  sgRNA
  Slc8a1_9
aatcccattgaaacattggg

SEQ ID NO: 57671 - DNA, 20 bp, Artificial Sequence
  sgRNA
  Slc8a1_10
gaacagttcaaagtgtcccc

SEQ ID NO: 57672 - DNA, 20 bp, Artificial Sequence
  sgRNA
  Slc8a1_11
gcgtctataggcaatgtcac

SEQ ID NO: 57673 - DNA, 20 bp, Artificial Sequence
  sgRNA
  Slc8a1_12
gctgttggtccccaccacaa

SEQ ID NO: 57674 - DNA, 20 bp, Artificial Sequence
  sgRNA
  Slc8a1_13
actgttccccgttggccgca

SEQ ID NO: 57675 - DNA, 20 bp, Artificial Sequence
  sgRNA
  Slc8a1_14
cacggaatctttcagaccaa

SEQ ID NO: 57676 - DNA, 20 bp, Artificial Sequence
  sgRNA
  Slc8a1_15
cggtcagtaggccgatcatg

SEQ ID NO: 57677 - DNA, 20 bp, Artificial Sequence
  sgRNA
  Slc8a1_16
catctaccatgcggccaacg

SEQ ID NO: 57678 - DNA, 20 bp, Artificial Sequence
  sgRNA
  Slc8a1_17
ggagcatctttgcctatacc

SEQ ID NO: 57679 - DNA, 20 bp, Artificial Sequence
  sgRNA
  Slc8a1_18
tgagatggtgattacagtag

SEQ ID NO: 57680 - DNA, 20 bp, Artificial Sequence
  sgRNA
  Slc8a1_19
tctcactcatctccaccaga

SEQ ID NO: 57681 - DNA, 20 bp, Artificial Sequence
  sgRNA
  Slc8a1_20
gagctggcaacatcttgaag

SEQ ID NO: 57682 - DNA, 20 bp, Artificial Sequence
  sgRNA
  Slc8a2_1
gtggactaccgtaccgagga

SEQ ID NO: 57683 - DNA, 20 bp, Artificial Sequence
  sgRNA
  Slc8a2_2
ttccactgcgagggtcggtg

SEQ ID NO: 57684 - DNA, 20 bp, Artificial Sequence
  sgRNA
  Slc8a2_3
atcctggacgacgaccacgc

SEQ ID NO: 57685 - DNA, 20 bp, Artificial Sequence
  sgRNA
  Slc8a2_4
cggcaatgatagacacaccc

SEQ ID NO: 57686 - DNA, 20 bp, Artificial Sequence
  sgRNA
  Slc8a2_5
ctacgtggactaccgtaccg

SEQ ID NO: 57687 - DNA, 20 bp, Artificial Sequence
  sgRNA
  Slc8a2_6
ggcatgttcgagcccgacgg

SEQ ID NO: 57688 - DNA, 20 bp, Artificial Sequence
  sgRNA
  Slc8a2_7
tctaccgcatccaggccacg

SEQ ID NO: 57689 - DNA, 20 bp, Artificial Sequence
  sgRNA
  Slc8a2_8
catcctggacgacgaccacg

SEQ ID NO: 57690 - DNA, 20 bp, Artificial Sequence
  sgRNA
  Slc8a2_9
caaggactcagtcaacgccg

SEQ ID NO: 57691 - DNA, 20 bp, Artificial Sequence
  sgRNA
  Slc8a2_10
cgatgatgattccactgcga

SEQ ID NO: 57692 - DNA, 20 bp, Artificial Sequence
  sgRNA
  Slc8a2_11
gctgcctgtgtgggaacccg

SEQ ID NO: 57693 - DNA, 20 bp, Artificial Sequence
  sgRNA
  Slc8a2_12
gggcaacagcaccttctacg

SEQ ID NO: 57694 - DNA, 20 bp, Artificial Sequence
  sgRNA
  Slc8a2_13
tgagtgagtcccaatcacca

SEQ ID NO: 57695 - DNA, 20 bp, Artificial Sequence
  sgRNA
  Slc8a2_14
cgcacctgtcatcagccgcg

SEQ ID NO: 57696 - DNA, 20 bp, Artificial Sequence
  sgRNA
  Slc8a2_15
cacgttaccgatggacgcgt

SEQ ID NO: 57697 - DNA, 20 bp, Artificial Sequence
  sgRNA
  Slc8a2_16
ggatctggatgacctcacgc

SEQ ID NO: 57698 - DNA, 20 bp, Artificial Sequence
  sgRNA
  Slc8a2_17
ggtacggtagtccacgtaga

SEQ ID NO: 57699 - DNA, 20 bp, Artificial Sequence
  sgRNA
  Slc8a2_18
cgtaatgtacaccaccgcca

SEQ ID NO: 57700 - DNA, 20 bp, Artificial Sequence
  sgRNA
  Slc8a2_19
gaactttccagaataccgtc

SEQ ID NO: 57701 - DNA, 20 bp, Artificial Sequence
  sgRNA
  Slc8a2_20
ggaatcatcatcggggcaga

SEQ ID NO: 57702 - DNA, 20 bp, Artificial Sequence
  sgRNA
  Slc8a3_1
agaacaatgagtcctgttcg

SEQ ID NO: 57703 - DNA, 20 bp, Artificial Sequence
  sgRNA
  Slc8a3_2
taccgcacagataaacaccg

SEQ ID NO: 57704 - DNA, 20 bp, Artificial Sequence
  sgRNA
  Slc8a3_3
gtacgtggactacaaaacag

SEQ ID NO: 57705 - DNA, 20 bp, Artificial Sequence
  sgRNA
  Slc8a3_4
ctgggaccatctaccatcgt

SEQ ID NO: 57706 - DNA, 20 bp, Artificial Sequence
  sgRNA
  Slc8a3_5
ggaggtagatgaatctcgca

SEQ ID NO: 57707 - DNA, 20 bp, Artificial Sequence
  sgRNA
  Slc8a3_6
gcgtggcaaatagtatgtag

SEQ ID NO: 57708 - DNA, 20 bp, Artificial Sequence
  sgRNA
  Slc8a3_7
gcaccttccagaagaccgtc

SEQ ID NO: 57709 - DNA, 20 bp, Artificial Sequence
  sgRNA
  Slc8a3_8
gggtcatcagactgcaagga

SEQ ID NO: 57710 - DNA, 20 bp, Artificial Sequence
  sgRNA
  Slc8a3_9
cgcaccagtcatcatccggg

SEQ ID NO: 57711 - DNA, 20 bp, Artificial Sequence
  sgRNA
  Slc8a3_10
gaagacctccagcatgagcg

SEQ ID NO: 57712 - DNA, 20 bp, Artificial Sequence
  sgRNA
  Slc8a3_11
ggcaaagtcctccggctcat

SEQ ID NO: 57713 - DNA, 20 bp, Artificial Sequence
  sgRNA
  Slc8a3_12
gcagactatgagttcacaga

SEQ ID NO: 57714 - DNA, 20 bp, Artificial Sequence
  sgRNA
  Slc8a3_13
gtgtgctcttgtatcgtcgg

SEQ ID NO: 57715 - DNA, 20 bp, Artificial Sequence
  sgRNA
  Slc8a3_14
cggtgagcatgccaataatg

SEQ ID NO: 57716 - DNA, 20 bp, Artificial Sequence
  sgRNA
  Slc8a3_15
tatatccaagaccatgtacg

SEQ ID NO: 57717 - DNA, 20 bp, Artificial Sequence
  sgRNA
  Slc8a3_16
gtagcagtaggcctccagcg

SEQ ID NO: 57718 - DNA, 20 bp, Artificial Sequence
  sgRNA
  Slc8a3_17
gcacaactacaattcgggta

SEQ ID NO: 57719 - DNA, 20 bp, Artificial Sequence
  sgRNA
  Slc8a3_18
agtcattacttcccaagaga

SEQ ID NO: 57720 - DNA, 20 bp, Artificial Sequence
  sgRNA
  Slc8a3_19
gatcatatagagccaaatgt

SEQ ID NO: 57721 - DNA, 20 bp, Artificial Sequence
  sgRNA
  Slc8a3_20
gctcacaaagagccatgtcg

SEQ ID NO: 57722 - DNA, 20 bp, Artificial Sequence
  sgRNA
  Slc8b1_1
tgaccacgtagaacacgtag

SEQ ID NO: 57723 - DNA, 20 bp, Artificial Sequence
  sgRNA
  Slc8b1_2
ccacacacggctcggcactg

SEQ ID NO: 57724 - DNA, 20 bp, Artificial Sequence
  sgRNA
  Slc8b1_3
tggaccccgacaaggacgat

SEQ ID NO: 57725 - DNA, 20 bp, Artificial Sequence
  sgRNA
  Slc8b1_4
ccacactcacaacttggccg

SEQ ID NO: 57726 - DNA, 20 bp, Artificial Sequence
  sgRNA
  Slc8b1_5
tctgcacttgggtctaccaa

SEQ ID NO: 57727 - DNA, 20 bp, Artificial Sequence
  sgRNA
  Slc8b1_6
aggcggagaaggccatccga

SEQ ID NO: 57728 - DNA, 20 bp, Artificial Sequence
  sgRNA
  Slc8b1_7
gggcctctacgtgttctacg

SEQ ID NO: 57729 - DNA, 20 bp, Artificial Sequence
  sgRNA
  Slc8b1_8
gtttcctgaccagtgccctg

SEQ ID NO: 57730 - DNA, 20 bp, Artificial Sequence
  sgRNA
  Slc8b1_9
gggtcaggaccaggaccagg

SEQ ID NO: 57731 - DNA, 20 bp, Artificial Sequence
  sgRNA
  Slc8b1_10
tggcccgccaaggataccct

SEQ ID NO: 57732 - DNA, 20 bp, Artificial Sequence
  sgRNA
  Slc8b1_11
ctacgtgttctacgtggtca

SEQ ID NO: 57733 - DNA, 20 bp, Artificial Sequence
  sgRNA
  Slc8b1_12
gcctgagcaacaccgtccta

SEQ ID NO: 57734 - DNA, 20 bp, Artificial Sequence
  sgRNA
  Slc8b1_13
ggctacctggactaccttga

SEQ ID NO: 57735 - DNA, 20 bp, Artificial Sequence
  sgRNA
  Slc8b1_14
ctgtgagcaggaccacaaca

SEQ ID NO: 57736 - DNA, 20 bp, Artificial Sequence
  sgRNA
  Slc8b1_15
tgccttctcagatttcacgc

SEQ ID NO: 57737 - DNA, 20 bp, Artificial Sequence
  sgRNA
  Slc8b1_16
agggggttctctgttagacg

SEQ ID NO: 57738 - DNA, 20 bp, Artificial Sequence
  sgRNA
  Slc8b1_17
gatgatgcccccgaaacagg

SEQ ID NO: 57739 - DNA, 20 bp, Artificial Sequence
  sgRNA
  Slc8b1_18
aattccgatcgtccttgtcg

SEQ ID NO: 57740 - DNA, 20 bp, Artificial Sequence
  sgRNA
  Slc8b1_19
cctcaaactctcccacaacg

SEQ ID NO: 57741 - DNA, 20 bp, Artificial Sequence
  sgRNA
  Slc8b1_20
ggtcctgaccctgcagtcgg

SEQ ID NO: 57742 - DNA, 20 bp, Artificial Sequence
  sgRNA
  Slc9a1_1
acggccaacaggtcgaccag

SEQ ID NO: 57743 - DNA, 20 bp, Artificial Sequence
  sgRNA
  Slc9a1_2
ggggcgcatcactactcctg

SEQ ID NO: 57744 - DNA, 20 bp, Artificial Sequence
  sgRNA
  Slc9a1_3
cgcccacaaacaccccaccg

SEQ ID NO: 57745 - DNA, 20 bp, Artificial Sequence
  sgRNA
  Slc9a1_4
gaaggtccagttccactggt

SEQ ID NO: 57746 - DNA, 20 bp, Artificial Sequence
  sgRNA
  Slc9a1_5
tccccaattgagcgttcccg

SEQ ID NO: 57747 - DNA, 20 bp, Artificial Sequence
  sgRNA
  Slc9a1_6
aacaaagcgctccatcaacg

SEQ ID NO: 57748 - DNA, 20 bp, Artificial Sequence
  sgRNA
  Slc9a1_7
ggtcctctatcacctctttg

SEQ ID NO: 57749 - DNA, 20 bp, Artificial Sequence
  sgRNA
  Slc9a1_8
gatgtgagaggtaaatcggg

SEQ ID NO: 57750 - DNA, 20 bp, Artificial Sequence
  sgRNA
  Slc9a1_9
gctcaacgatgccgtcactg

SEQ ID NO: 57751 - DNA, 20 bp, Artificial Sequence
  sgRNA
  Slc9a1_10
gctggtggccgacccctacg

SEQ ID NO: 57752 - DNA, 20 bp, Artificial Sequence
  sgRNA
  Slc9a1_11
gcagccccactacgatcagc

SEQ ID NO: 57753 - DNA, 20 bp, Artificial Sequence
  sgRNA
  Slc9a1_12
cccggatgtgagaggtaaat

SEQ ID NO: 57754 - DNA, 20 bp, Artificial Sequence
  sgRNA
  Slc9a1_13
ttatggccaccatcactgga

SEQ ID NO: 57755 - DNA, 20 bp, Artificial Sequence
  sgRNA
  Slc9a1_14
tctggggatttcatccacct

SEQ ID NO: 57756 - DNA, 20 bp, Artificial Sequence
  sgRNA
  Slc9a1_15
gatgatgctgccaaagagca

SEQ ID NO: 57757 - DNA, 20 bp, Artificial Sequence
  sgRNA
  Slc9a1_16
atctgcagaaaacccggcaa

SEQ ID NO: 57758 - DNA, 20 bp, Artificial Sequence
  sgRNA
  Slc9a1_17
tgaggaacaggtcacacatg

SEQ ID NO: 57759 - DNA, 20 bp, Artificial Sequence
  sgRNA
  Slc9a1_18
agacggccagcacagccaca

SEQ ID NO: 57760 - DNA, 20 bp, Artificial Sequence
  sgRNA
  Slc9a1_19
agtgacggcatcgttgagca

SEQ ID NO: 57761 - DNA, 20 bp, Artificial Sequence
  sgRNA
  Slc9a1_20
ggttccaggcttcctcgtag

SEQ ID NO: 57762 - DNA, 20 bp, Artificial Sequence
  sgRNA
  Slc9a2_1
ggtcagcacctacccgacag

SEQ ID NO: 57763 - DNA, 20 bp, Artificial Sequence
  sgRNA
  Slc9a2_2
tcgaaagggatttgcacgtg

SEQ ID NO: 57764 - DNA, 20 bp, Artificial Sequence
  sgRNA
  Slc9a2_3
agttcatcattgcctacgga

SEQ ID NO: 57765 - DNA, 20 bp, Artificial Sequence
  sgRNA
  Slc9a2_4
acgccatgatgcctgaaagg

SEQ ID NO: 57766 - DNA, 20 bp, Artificial Sequence
  sgRNA
  Slc9a2_5
acgctgctatgaatcccagg

SEQ ID NO: 57767 - DNA, 20 bp, Artificial Sequence
  sgRNA
  Slc9a2_6
ataatggtcgggcttctact

SEQ ID NO: 57768 - DNA, 20 bp, Artificial Sequence
  sgRNA
  Slc9a2_7
gcgccccgcagtaaagacgg

SEQ ID NO: 57769 - DNA, 20 bp, Artificial Sequence
  sgRNA
  Slc9a2_8
cttcgtcgtgggtattggcg

SEQ ID NO: 57770 - DNA, 20 bp, Artificial Sequence
  sgRNA
  Slc9a2_9
aggtaaggataaatatcggg

SEQ ID NO: 57771 - DNA, 20 bp, Artificial Sequence
  sgRNA
  Slc9a2_10
gatttcagctgtggaccccg

SEQ ID NO: 57772 - DNA, 20 bp, Artificial Sequence
  sgRNA
  Slc9a2_11
gatgttgtgtgtgaaacggg

SEQ ID NO: 57773 - DNA, 20 bp, Artificial Sequence
  sgRNA
  Slc9a2_12
gggctgcaaattgagcacag

SEQ ID NO: 57774 - DNA, 20 bp, Artificial Sequence
  sgRNA
  Slc9a2_13
tgacggcagacacaagcgag

SEQ ID NO: 57775 - DNA, 20 bp, Artificial Sequence
  sgRNA
  Slc9a2_14
ttgcacgtgggggtaatcca

SEQ ID NO: 57776 - DNA, 20 bp, Artificial Sequence
  sgRNA
  Slc9a2_15
gtgcccccgtctttactgcg

SEQ ID NO: 57777 - DNA, 20 bp, Artificial Sequence
  sgRNA
  Slc9a2_16
gctcaacgatgcagtcacag

SEQ ID NO: 57778 - DNA, 20 bp, Artificial Sequence
  sgRNA
  Slc9a2_17
ctaatttcatccatttcgcc

SEQ ID NO: 57779 - DNA, 20 bp, Artificial Sequence
  sgRNA
  Slc9a2_18
ccagcatccagaacgatggg

SEQ ID NO: 57780 - DNA, 20 bp, Artificial Sequence
  sgRNA
  Slc9a2_19
ctataacagacacaacctga

SEQ ID NO: 57781 - DNA, 20 bp, Artificial Sequence
  sgRNA
  Slc9a2_20
atctctatcaaatccgtcag

SEQ ID NO: 57782 - DNA, 20 bp, Artificial Sequence
  sgRNA
  Slc9a3_1
cttcatagtgtagcgcacag

SEQ ID NO: 57783 - DNA, 20 bp, Artificial Sequence
  sgRNA
  Slc9a3_2
cattgcgctctggatcctcg

SEQ ID NO: 57784 - DNA, 20 bp, Artificial Sequence
  sgRNA
  Slc9a3_3
acttacccatcaagccactg

SEQ ID NO: 57785 - DNA, 20 bp, Artificial Sequence
  sgRNA
  Slc9a3_4
cttggtgaagcgagtcacca

SEQ ID NO: 57786 - DNA, 20 bp, Artificial Sequence
  sgRNA
  Slc9a3_5
gtacctgtacaagcctcggc

SEQ ID NO: 57787 - DNA, 20 bp, Artificial Sequence
  sgRNA
  Slc9a3_6
ccgcctcagcaacaaatccg

SEQ ID NO: 57788 - DNA, 20 bp, Artificial Sequence
  sgRNA
  Slc9a3_7
ccagcatccaacacaatagg

SEQ ID NO: 57789 - DNA, 20 bp, Artificial Sequence
  sgRNA
  Slc9a3_8
ggacccaagcatcctatcca

SEQ ID NO: 57790 - DNA, 20 bp, Artificial Sequence
  sgRNA
  Slc9a3_9
cgatgagtagagcactctcg

SEQ ID NO: 57791 - DNA, 20 bp, Artificial Sequence
  sgRNA
  Slc9a3_10
gctgtcccctggggagaccg

SEQ ID NO: 57792 - DNA, 20 bp, Artificial Sequence
  sgRNA
  Slc9a3_11
catagtgtagcgcacagtgg

SEQ ID NO: 57793 - DNA, 20 bp, Artificial Sequence
  sgRNA
  Slc9a3_12
ggcggaatggtgtcaggcgg

SEQ ID NO: 57794 - DNA, 20 bp, Artificial Sequence
  sgRNA
  Slc9a3_13
tgtagcttctcattgagctt

SEQ ID NO: 57795 - DNA, 20 bp, Artificial Sequence
  sgRNA
  Slc9a3_14
ggaactttcagagcatgagg

SEQ ID NO: 57796 - DNA, 20 bp, Artificial Sequence
  sgRNA
  Slc9a3_15
ggttcacagctgagataccc

SEQ ID NO: 57797 - DNA, 20 bp, Artificial Sequence
  sgRNA
  Slc9a3_16
aggtagaagaagaagagcgt

SEQ ID NO: 57798 - DNA, 20 bp, Artificial Sequence
  sgRNA
  Slc9a3_17
gttgccaaagaagagtcgat

SEQ ID NO: 57799 - DNA, 20 bp, Artificial Sequence
  sgRNA
  Slc9a3_18
agggcaccacggtctcccca

SEQ ID NO: 57800 - DNA, 20 bp, Artificial Sequence
  sgRNA
  Slc9a3_19
tgacaaagacagcatctcgg

SEQ ID NO: 57801 - DNA, 20 bp, Artificial Sequence
  sgRNA
  Slc9a3_20
agtggcagttctatagagcc

SEQ ID NO: 57802 - DNA, 20 bp, Artificial Sequence
  sgRNA
  Slc9a6_1
ggaaagtgtcctcaatgacg

SEQ ID NO: 57803 - DNA, 20 bp, Artificial Sequence
  sgRNA
  Slc9a6_2
gaatgccgtaccgaagcacg

SEQ ID NO: 57804 - DNA, 20 bp, Artificial Sequence
  sgRNA
  Slc9a6_3
tttaacccaacatttgtcgt

SEQ ID NO: 57805 - DNA, 20 bp, Artificial Sequence
  sgRNA
  Slc9a6_4
catatgctaagatagaccca

SEQ ID NO: 57806 - DNA, 20 bp, Artificial Sequence
  sgRNA
  Slc9a6_5
atagtggcataccagccagc

SEQ ID NO: 57807 - DNA, 20 bp, Artificial Sequence
  sgRNA
  Slc9a6_6
tcatctaatgaatttaacgc

SEQ ID NO: 57808 - DNA, 20 bp, Artificial Sequence
  sgRNA
  Slc9a6_7
gtcacattattcacatcgct

SEQ ID NO: 57809 - DNA, 20 bp, Artificial Sequence
  sgRNA
  Slc9a6_8
agtcattcgtggcacacgcc

SEQ ID NO: 57810 - DNA, 20 bp, Artificial Sequence
  sgRNA
  Slc9a6_9
actctacgctcttctcttcg

SEQ ID NO: 57811 - DNA, 20 bp, Artificial Sequence
  sgRNA
  Slc9a6_10
tagcaaggccggtttcgtgc

SEQ ID NO: 57812 - DNA, 20 bp, Artificial Sequence
  sgRNA
  Slc9a6_11
gttaaagacgtgattctgga

SEQ ID NO: 57813 - DNA, 20 bp, Artificial Sequence
  sgRNA
  Slc9a6_12
gctgaagcatggggtttcac

SEQ ID NO: 57814 - DNA, 20 bp, Artificial Sequence
  sgRNA
  Slc9a6_13
gtgtggctgttgtctcccgc

SEQ ID NO: 57815 - DNA, 20 bp, Artificial Sequence
  sgRNA
  Slc9a6_14
gctgggagtgtggtagtcag

SEQ ID NO: 57816 - DNA, 20 bp, Artificial Sequence
  sgRNA
  Slc9a6_15
gaagagccagatcgtcagaa

SEQ ID NO: 57817 - DNA, 20 bp, Artificial Sequence
  sgRNA
  Slc9a6_16
gtaggcctcgtgcttcggta

SEQ ID NO: 57818 - DNA, 20 bp, Artificial Sequence
  sgRNA
  Slc9a6_17
aacgaccagagccatggacg

SEQ ID NO: 57819 - DNA, 20 bp, Artificial Sequence
  sgRNA
  Slc9a6_18
gcccgcttcctgcacgaaac

SEQ ID NO: 57820 - DNA, 20 bp, Artificial Sequence
  sgRNA
  Slc9a6_19
cgtgtccgagaagcaggcgg

SEQ ID NO: 57821 - DNA, 20 bp, Artificial Sequence
  sgRNA
  Slc9a6_20
aatctattggaatcttcctt

SEQ ID NO: 57822 - DNA, 20 bp, Artificial Sequence
  sgRNA
  Slc9a7_1
tacttacgaggatagtacaa

SEQ ID NO: 57823 - DNA, 20 bp, Artificial Sequence
  sgRNA
  Slc9a7_2
catgaaggaaacgcacccgg

SEQ ID NO: 57824 - DNA, 20 bp, Artificial Sequence
  sgRNA
  Slc9a7_3
cagaaatcttatgtatggag

SEQ ID NO: 57825 - DNA, 20 bp, Artificial Sequence
  sgRNA
  Slc9a7_4
ccctggcaagatcaacaacg

SEQ ID NO: 57826 - DNA, 20 bp, Artificial Sequence
  sgRNA
  Slc9a7_5
tatggcacccctgctaccag

SEQ ID NO: 57827 - DNA, 20 bp, Artificial Sequence
  sgRNA
  Slc9a7_6
accacactcgagacttgtgg

SEQ ID NO: 57828 - DNA, 20 bp, Artificial Sequence
  sgRNA
  Slc9a7_7
gagaccagaaggtttccagc

SEQ ID NO: 57829 - DNA, 20 bp, Artificial Sequence
  sgRNA
  Slc9a7_8
gcatgagtgtttagtcctgc

SEQ ID NO: 57830 - DNA, 20 bp, Artificial Sequence
  sgRNA
  Slc9a7_9
attgttgcctatcaaccagc

SEQ ID NO: 57831 - DNA, 20 bp, Artificial Sequence
  sgRNA
  Slc9a7_10
aggtgaggtcaccttccgtt

SEQ ID NO: 57832 - DNA, 20 bp, Artificial Sequence
  sgRNA
  Slc9a7_11
tgaaagctgtcattgttagg

SEQ ID NO: 57833 - DNA, 20 bp, Artificial Sequence
  sgRNA
  Slc9a7_12
tcctgcagtggaaacacgag

SEQ ID NO: 57834 - DNA, 20 bp, Artificial Sequence
  sgRNA
  Slc9a7_13
tctgatttcatcctaacgga

SEQ ID NO: 57835 - DNA, 20 bp, Artificial Sequence
  sgRNA
  Slc9a7_14
gcagaatgacatgctgcgga

SEQ ID NO: 57836 - DNA, 20 bp, Artificial Sequence
  sgRNA
  Slc9a7_15
gatagcaccgtgacagcaaa

SEQ ID NO: 57837 - DNA, 20 bp, Artificial Sequence
  sgRNA
  Slc9a7_16
ttcctgcagtggaaacacga

SEQ ID NO: 57838 - DNA, 20 bp, Artificial Sequence
  sgRNA
  Slc9a7_17
tcagagtcatcttctctcag

SEQ ID NO: 57839 - DNA, 20 bp, Artificial Sequence
  sgRNA
  Slc9a7_18
agatatgtgcagctcttccc

SEQ ID NO: 57840 - DNA, 20 bp, Artificial Sequence
  sgRNA
  Slc9a7_19
tgactctgatttcatcctaa

SEQ ID NO: 57841 - DNA, 20 bp, Artificial Sequence
  sgRNA
  Slc9a7_20
gcggtgcttgaaaagccaga

SEQ ID NO: 57842 - DNA, 20 bp, Artificial Sequence
  sgRNA
  Slco1a1_1
aaatatccaaggcatactgg

SEQ ID NO: 57843 - DNA, 20 bp, Artificial Sequence
  sgRNA
  Slco1a1_2
ctaataggaaatactatgcg

SEQ ID NO: 57844 - DNA, 20 bp, Artificial Sequence
  sgRNA
  Slco1a1_3
agcaactgggaaattatcac

SEQ ID NO: 57845 - DNA, 20 bp, Artificial Sequence
  sgRNA
  Slco1a1_4
atgccattaagaaacacccc

SEQ ID NO: 57846 - DNA, 20 bp, Artificial Sequence
  sgRNA
  Slco1a1_5
tcgatgtaagaaatacccaa

SEQ ID NO: 57847 - DNA, 20 bp, Artificial Sequence
  sgRNA
  Slco1a1_6
tcagaggcagtattcctcat

SEQ ID NO: 57848 - DNA, 20 bp, Artificial Sequence
  sgRNA
  Slco1a1_7
gaaactcccataatgccctt

SEQ ID NO: 57849 - DNA, 20 bp, Artificial Sequence
  sgRNA
  Slco1a1_8
tctgaaatgtggtcaaccag

SEQ ID NO: 57850 - DNA, 20 bp, Artificial Sequence
  sgRNA
  Slco1a1_9
cacaaggtgcagctgcttaa

SEQ ID NO: 57851 - DNA, 20 bp, Artificial Sequence
  sgRNA
  Slco1a1_10
gcatcacctcatttcctcat

SEQ ID NO: 57852 - DNA, 20 bp, Artificial Sequence
  sgRNA
  Slco1a1_11
gcagcttgttgtcacactca

SEQ ID NO: 57853 - DNA, 20 bp, Artificial Sequence
  sgRNA
  Slco1a1_12
ggattagaatgaagactgcg

SEQ ID NO: 57854 - DNA, 20 bp, Artificial Sequence
  sgRNA
  Slco1a1_13
tcagaagaaccatgtatcca

SEQ ID NO: 57855 - DNA, 20 bp, Artificial Sequence
  sgRNA
  Slco1a1_14
acgagtgtgctccagataaa

SEQ ID NO: 57856 - DNA, 20 bp, Artificial Sequence
  sgRNA
  Slco1a1_15
catccaacaccaataatgat

SEQ ID NO: 57857 - DNA, 20 bp, Artificial Sequence
  sgRNA
  Slco1a1_16
tcactgctgcaggcaacccc

SEQ ID NO: 57858 - DNA, 20 bp, Artificial Sequence
  sgRNA
  Slco1a1_17
aggccattgtccccacacac

SEQ ID NO: 57859 - DNA, 20 bp, Artificial Sequence
  sgRNA
  Slco1a1_18
atgtggatatatgtactaat

SEQ ID NO: 57860 - DNA, 20 bp, Artificial Sequence
  sgRNA
  Slco1a1_19
gggttgcctgcagcagtgag

SEQ ID NO: 57861 - DNA, 20 bp, Artificial Sequence
  sgRNA
  Slco1a1_20
agccactgattaaatatcca

SEQ ID NO: 57862 - DNA, 20 bp, Artificial Sequence
  sgRNA
  Slco1a4_1
ccaacgcaagacccaacagg

SEQ ID NO: 57863 - DNA, 20 bp, Artificial Sequence
  sgRNA
  Slco1a4_2
gataagcccaactacagacg

SEQ ID NO: 57864 - DNA, 20 bp, Artificial Sequence
  sgRNA
  Slco1a4_3
aaccaccaattaaatatccg

SEQ ID NO: 57865 - DNA, 20 bp, Artificial Sequence
  sgRNA
  Slco1a4_4
aaaatcaaggaggaaaaccg

SEQ ID NO: 57866 - DNA, 20 bp, Artificial Sequence
  sgRNA
  Slco1a4_5
gctgagatagtcttcctcat

SEQ ID NO: 57867 - DNA, 20 bp, Artificial Sequence
  sgRNA
  Slco1a4_6
atatgcctcggatatttaat

SEQ ID NO: 57868 - DNA, 20 bp, Artificial Sequence
  sgRNA
  Slco1a4_7
ttagaaacaggaatgaccat

SEQ ID NO: 57869 - DNA, 20 bp, Artificial Sequence
  sgRNA
  Slco1a4_8
agtcctacgatgcagaatga

SEQ ID NO: 57870 - DNA, 20 bp, Artificial Sequence
  sgRNA
  Slco1a4_9
taagcccaactacagacgtg

SEQ ID NO: 57871 - DNA, 20 bp, Artificial Sequence
  sgRNA
  Slco1a4_10
gcagtgagcttcatttctgc

SEQ ID NO: 57872 - DNA, 20 bp, Artificial Sequence
  sgRNA
  Slco1a4_11
ggattaggatgaagagtgca

SEQ ID NO: 57873 - DNA, 20 bp, Artificial Sequence
  sgRNA
  Slco1a4_12
gtatccccacgtctgtagtt

SEQ ID NO: 57874 - DNA, 20 bp, Artificial Sequence
  sgRNA
  Slco1a4_13
ccaaaaacactcctaaagga

SEQ ID NO: 57875 - DNA, 20 bp, Artificial Sequence
  sgRNA
  Slco1a4_14
actcaaatagagagacaatt

SEQ ID NO: 57876 - DNA, 20 bp, Artificial Sequence
  sgRNA
  Slco1a4_15
ctttccaaaaacactcctaa

SEQ ID NO: 57877 - DNA, 20 bp, Artificial Sequence
  sgRNA
  Slco1a4_16
ggctgtttcatcttctcgct

SEQ ID NO: 57878 - DNA, 20 bp, Artificial Sequence
  sgRNA
  Slco1a4_17
ccaacagaagtccaatcaaa

SEQ ID NO: 57879 - DNA, 20 bp, Artificial Sequence
  sgRNA
  Slco1a4_18
ctgaagagtcgatgtcccca

SEQ ID NO: 57880 - DNA, 20 bp, Artificial Sequence
  sgRNA
  Slco1a4_19
ataagcccaactacagacgt

SEQ ID NO: 57881 - DNA, 20 bp, Artificial Sequence
  sgRNA
  Slco1a4_20
atacatgtcagcttgcctcg

SEQ ID NO: 57882 - DNA, 20 bp, Artificial Sequence
  sgRNA
  Slco1a5_1
ctggtaggaaacatcatacg

SEQ ID NO: 57883 - DNA, 20 bp, Artificial Sequence
  sgRNA
  Slco1a5_2
agacagaaggtactcaaaca

SEQ ID NO: 57884 - DNA, 20 bp, Artificial Sequence
  sgRNA
  Slco1a5_3
agaatacttaccggcccatg

SEQ ID NO: 57885 - DNA, 20 bp, Artificial Sequence
  sgRNA
  Slco1a5_4
aatgaacggacatacctatg

SEQ ID NO: 57886 - DNA, 20 bp, Artificial Sequence
  sgRNA
  Slco1a5_5
gtatcagaatgaagaatgca

SEQ ID NO: 57887 - DNA, 20 bp, Artificial Sequence
  sgRNA
  Slco1a5_6
attcgatcacagccatacct

SEQ ID NO: 57888 - DNA, 20 bp, Artificial Sequence
  sgRNA
  Slco1a5_7
cagaagagtacatttcccca

SEQ ID NO: 57889 - DNA, 20 bp, Artificial Sequence
  sgRNA
  Slco1a5_8
gcagcttgttagcacactca

SEQ ID NO: 57890 - DNA, 20 bp, Artificial Sequence
  sgRNA
  Slco1a5_9
tgttggaatgggaacccaca

SEQ ID NO: 57891 - DNA, 20 bp, Artificial Sequence
  sgRNA
  Slco1a5_10
agacctatcatgattggtat

SEQ ID NO: 57892 - DNA, 20 bp, Artificial Sequence
  sgRNA
  Slco1a5_11
ccttgttctccacatataga

SEQ ID NO: 57893 - DNA, 20 bp, Artificial Sequence
  sgRNA
  Slco1a5_12
tgcgtgtaatccaattccaa

SEQ ID NO: 57894 - DNA, 20 bp, Artificial Sequence
  sgRNA
  Slco1a5_13
tcagaggtcgtcctcctcat

SEQ ID NO: 57895 - DNA, 20 bp, Artificial Sequence
  sgRNA
  Slco1a5_14
aaatatccaatgcagattgg

SEQ ID NO: 57896 - DNA, 20 bp, Artificial Sequence
  sgRNA
  Slco1a5_15
atacatgtcagcctgcctcg

SEQ ID NO: 57897 - DNA, 20 bp, Artificial Sequence
  sgRNA
  Slco1a5_16
gtagctgcttaacaaacaca

SEQ ID NO: 57898 - DNA, 20 bp, Artificial Sequence
  sgRNA
  Slco1a5_17
aagtctgaagagaagtccct

SEQ ID NO: 57899 - DNA, 20 bp, Artificial Sequence
  sgRNA
  Slco1a5_18
ttatctggagcacacttgtc

SEQ ID NO: 57900 - DNA, 20 bp, Artificial Sequence
  sgRNA
  Slco1a5_19
gtggtgagccaggagcctgt

SEQ ID NO: 57901 - DNA, 20 bp, Artificial Sequence
  sgRNA
  Slco1a5_20
gctttattatgaagaagttc

SEQ ID NO: 57902 - DNA, 20 bp, Artificial Sequence
  sgRNA
  Slco1a6_1
agttaagccggcaattggag

SEQ ID NO: 57903 - DNA, 20 bp, Artificial Sequence
  sgRNA
  Slco1a6_2
aatgaaagtacataccaatg

SEQ ID NO: 57904 - DNA, 20 bp, Artificial Sequence
  sgRNA
  Slco1a6_3
caaacatttatgtagacaca

SEQ ID NO: 57905 - DNA, 20 bp, Artificial Sequence
  sgRNA
  Slco1a6_4
gtgatattatgaaacaccct

SEQ ID NO: 57906 - DNA, 20 bp, Artificial Sequence
  sgRNA
  Slco1a6_5
ggattgcctgcagctctaag

SEQ ID NO: 57907 - DNA, 20 bp, Artificial Sequence
  sgRNA
  Slco1a6_6
tgtgataccactccaattgc

SEQ ID NO: 57908 - DNA, 20 bp, Artificial Sequence
  sgRNA
  Slco1a6_7
ctgaagagtcagtgtcccca

SEQ ID NO: 57909 - DNA, 20 bp, Artificial Sequence
  sgRNA
  Slco1a6_8
gaagcttgttagcacagtca

SEQ ID NO: 57910 - DNA, 20 bp, Artificial Sequence
  sgRNA
  Slco1a6_9
tctatataggaaatacctaa

SEQ ID NO: 57911 - DNA, 20 bp, Artificial Sequence
  sgRNA
  Slco1a6_10
actcgttagcaaccatacct

SEQ ID NO: 57912 - DNA, 20 bp, Artificial Sequence
  sgRNA
  Slco1a6_11
gtaactgcttaacaaaaaca

SEQ ID NO: 57913 - DNA, 20 bp, Artificial Sequence
  sgRNA
  Slco1a6_12
acataaatgtttgcacagaa

SEQ ID NO: 57914 - DNA, 20 bp, Artificial Sequence
  sgRNA
  Slco1a6_13
ggttagcataaagttacaaa

SEQ ID NO: 57915 - DNA, 20 bp, Artificial Sequence
  sgRNA
  Slco1a6_14
ctgcaggcaatccaagatag

SEQ ID NO: 57916 - DNA, 20 bp, Artificial Sequence
  sgRNA
  Slco1a6_15
agtcttagaatgaagaatga

SEQ ID NO: 57917 - DNA, 20 bp, Artificial Sequence
  sgRNA
  Slco1a6_16
atcaaagcgccaaagtaaat

SEQ ID NO: 57918 - DNA, 20 bp, Artificial Sequence
  sgRNA
  Slco1a6_17
gcaaaggcagtcttcctcat

SEQ ID NO: 57919 - DNA, 20 bp, Artificial Sequence
  sgRNA
  Slco1a6_18
gacagaacatgcttacattg

SEQ ID NO: 57920 - DNA, 20 bp, Artificial Sequence
  sgRNA
  Slco1a6_19
agttctaaggtcgagaacga

SEQ ID NO: 57921 - DNA, 20 bp, Artificial Sequence
  sgRNA
  Slco1a6_20
gcaggctgtgaaaagtctgt

SEQ ID NO: 57922 - DNA, 20 bp, Artificial Sequence
  sgRNA
  Slco1b2_1
gctaagctatacgtagacgt

SEQ ID NO: 57923 - DNA, 20 bp, Artificial Sequence
  sgRNA
  Slco1b2_2
atatgacaggtagaacacat

SEQ ID NO: 57924 - DNA, 20 bp, Artificial Sequence
  sgRNA
  Slco1b2_3
atttccggtttgattgatgg

SEQ ID NO: 57925 - DNA, 20 bp, Artificial Sequence
  sgRNA
  Slco1b2_4
attgactaaacaggtcaacg

SEQ ID NO: 57926 - DNA, 20 bp, Artificial Sequence
  sgRNA
  Slco1b2_5
catctatgtgagagtccact

SEQ ID NO: 57927 - DNA, 20 bp, Artificial Sequence
  sgRNA
  Slco1b2_6
ctacaccgaccaaagctgat

SEQ ID NO: 57928 - DNA, 20 bp, Artificial Sequence
  sgRNA
  Slco1b2_7
gagcatcctgaggagttatg

SEQ ID NO: 57929 - DNA, 20 bp, Artificial Sequence
  sgRNA
  Slco1b2_8
gaaaccccaatagtgcccct

SEQ ID NO: 57930 - DNA, 20 bp, Artificial Sequence
  sgRNA
  Slco1b2_9
gcgttgccacatttcttcat

SEQ ID NO: 57931 - DNA, 20 bp, Artificial Sequence
  sgRNA
  Slco1b2_10
ctgcatactatagcaatgat

SEQ ID NO: 57932 - DNA, 20 bp, Artificial Sequence
  sgRNA
  Slco1b2_11
gcaatgatcggaccaatcct

SEQ ID NO: 57933 - DNA, 20 bp, Artificial Sequence
  sgRNA
  Slco1b2_12
ggttgcttcatcatgggcat

SEQ ID NO: 57934 - DNA, 20 bp, Artificial Sequence
  sgRNA
  Slco1b2_13
gagaagacaaggcactgcga

SEQ ID NO: 57935 - DNA, 20 bp, Artificial Sequence
  sgRNA
  Slco1b2_14
gcaggatgcaaatcatttcg

SEQ ID NO: 57936 - DNA, 20 bp, Artificial Sequence
  sgRNA
  Slco1b2_15
attaatgccccataatagac

SEQ ID NO: 57937 - DNA, 20 bp, Artificial Sequence
  sgRNA
  Slco1b2_16
tcaatgtaggaaactcctag

SEQ ID NO: 57938 - DNA, 20 bp, Artificial Sequence
  sgRNA
  Slco1b2_17
gtttggtcagacagcatcgc

SEQ ID NO: 57939 - DNA, 20 bp, Artificial Sequence
  sgRNA
  Slco1b2_18
tcgcaggccaactttctgtt

SEQ ID NO: 57940 - DNA, 20 bp, Artificial Sequence
  sgRNA
  Slco1b2_19
gctgctctataaacttgaac

SEQ ID NO: 57941 - DNA, 20 bp, Artificial Sequence
  sgRNA
  Slco1b2_20
taactcctcaggatgctcgt

SEQ ID NO: 57942 - DNA, 20 bp, Artificial Sequence
  sgRNA
  Slco1c1_1
gaagacataaacccacatgg

SEQ ID NO: 57943 - DNA, 20 bp, Artificial Sequence
  sgRNA
  Slco1c1_2
ccatataacaatcaccccaa

SEQ ID NO: 57944 - DNA, 20 bp, Artificial Sequence
  sgRNA
  Slco1c1_3
agctaacaaacgttatgacc

SEQ ID NO: 57945 - DNA, 20 bp, Artificial Sequence
  sgRNA
  Slco1c1_4
gggatgtgaaaattctagtg

SEQ ID NO: 57946 - DNA, 20 bp, Artificial Sequence
  sgRNA
  Slco1c1_5
attcagcgcaacctgccgga

SEQ ID NO: 57947 - DNA, 20 bp, Artificial Sequence
  sgRNA
  Slco1c1_6
tattaggtaaccaagccacc

SEQ ID NO: 57948 - DNA, 20 bp, Artificial Sequence
  sgRNA
  Slco1c1_7
gctcgttcatgataagagac

SEQ ID NO: 57949 - DNA, 20 bp, Artificial Sequence
  sgRNA
  Slco1c1_8
gagacgcctatccaacccct

SEQ ID NO: 57950 - DNA, 20 bp, Artificial Sequence
  sgRNA
  Slco1c1_9
agagcaaaagacttaagttg

SEQ ID NO: 57951 - DNA, 20 bp, Artificial Sequence
  sgRNA
  Slco1c1_10
ggcactgtacctgaaagcgt

SEQ ID NO: 57952 - DNA, 20 bp, Artificial Sequence
  sgRNA
  Slco1c1_11
ctggctgtcaatcctccagc

SEQ ID NO: 57953 - DNA, 20 bp, Artificial Sequence
  sgRNA
  Slco1c1_12
agtcggatatccgtccacag

SEQ ID NO: 57954 - DNA, 20 bp, Artificial Sequence
  sgRNA
  Slco1c1_13
ggacggatatccgactgtaa

SEQ ID NO: 57955 - DNA, 20 bp, Artificial Sequence
  sgRNA
  Slco1c1_14
cgacccactgaggatccttt

SEQ ID NO: 57956 - DNA, 20 bp, Artificial Sequence
  sgRNA
  Slco1c1_15
ccaggagcgtggttaatccc

SEQ ID NO: 57957 - DNA, 20 bp, Artificial Sequence
  sgRNA
  Slco1c1_16
tcctgggaaatcttctccga

SEQ ID NO: 57958 - DNA, 20 bp, Artificial Sequence
  sgRNA
  Slco1c1_17
accctcggagaagatttccc

SEQ ID NO: 57959 - DNA, 20 bp, Artificial Sequence
  sgRNA
  Slco1c1_18
caaaacaccaaagtacacag

SEQ ID NO: 57960 - DNA, 20 bp, Artificial Sequence
  sgRNA
  Slco1c1_19
ggatatccgactgtaaagga

SEQ ID NO: 57961 - DNA, 20 bp, Artificial Sequence
  sgRNA
  Slco1c1_20
gatgtcttcaagcatcaaaa

SEQ ID NO: 57962 - DNA, 20 bp, Artificial Sequence
  sgRNA
  Slco2a1_1
cccacggatgatcggcatag

SEQ ID NO: 57963 - DNA, 20 bp, Artificial Sequence
  sgRNA
  Slco2a1_2
actcgggggatggtttgcag

SEQ ID NO: 57964 - DNA, 20 bp, Artificial Sequence
  sgRNA
  Slco2a1_3
cttcgtggactacggcagag

SEQ ID NO: 57965 - DNA, 20 bp, Artificial Sequence
  sgRNA
  Slco2a1_4
ctctgcaaagtcgtccacat

SEQ ID NO: 57966 - DNA, 20 bp, Artificial Sequence
  sgRNA
  Slco2a1_5
cctatgctcagggagacgag

SEQ ID NO: 57967 - DNA, 20 bp, Artificial Sequence
  sgRNA
  Slco2a1_6
gtaggaccatcatgtagagg

SEQ ID NO: 57968 - DNA, 20 bp, Artificial Sequence
  sgRNA
  Slco2a1_7
gggatgttccacacccgccg

SEQ ID NO: 57969 - DNA, 20 bp, Artificial Sequence
  sgRNA
  Slco2a1_8
ctatgccgatcatccgtggg

SEQ ID NO: 57970 - DNA, 20 bp, Artificial Sequence
  sgRNA
  Slco2a1_9
agtcatgctgaggatcttcg

SEQ ID NO: 57971 - DNA, 20 bp, Artificial Sequence
  sgRNA
  Slco2a1_10
gtagttccaccggatacagg

SEQ ID NO: 57972 - DNA, 20 bp, Artificial Sequence
  sgRNA
  Slco2a1_11
gtgaaccgcccacggatgat

SEQ ID NO: 57973 - DNA, 20 bp, Artificial Sequence
  sgRNA
  Slco2a1_12
ggagaagcagtacgatgcct

SEQ ID NO: 57974 - DNA, 20 bp, Artificial Sequence
  sgRNA
  Slco2a1_13
gctcctctggacatcgctcg

SEQ ID NO: 57975 - DNA, 20 bp, Artificial Sequence
  sgRNA
  Slco2a1_14
tttccccgagcgatgtccag

SEQ ID NO: 57976 - DNA, 20 bp, Artificial Sequence
  sgRNA
  Slco2a1_15
tcgactcctcctgtatccgg

SEQ ID NO: 57977 - DNA, 20 bp, Artificial Sequence
  sgRNA
  Slco2a1_16
gcttctccaggaacttgttg

SEQ ID NO: 57978 - DNA, 20 bp, Artificial Sequence
  sgRNA
  Slco2a1_17
tccacataggagatcccaaa

SEQ ID NO: 57979 - DNA, 20 bp, Artificial Sequence
  sgRNA
  Slco2a1_18
gcctatgccaacttactcat

SEQ ID NO: 57980 - DNA, 20 bp, Artificial Sequence
  sgRNA
  Slco2a1_19
cgtaggaccatcatgtagag

SEQ ID NO: 57981 - DNA, 20 bp, Artificial Sequence
  sgRNA
  Slco2a1_20
cgatccaccgagggtcacct

SEQ ID NO: 57982 - DNA, 20 bp, Artificial Sequence
  sgRNA
  Slco2b1_1
tgtttggaataaccacgatg

SEQ ID NO: 57983 - DNA, 20 bp, Artificial Sequence
  sgRNA
  Slco2b1_2
gctgctagctgctttcaatg

SEQ ID NO: 57984 - DNA, 20 bp, Artificial Sequence
  sgRNA
  Slco2b1_3
agaaaccaagcatctgacca

SEQ ID NO: 57985 - DNA, 20 bp, Artificial Sequence
  sgRNA
  Slco2b1_4
gcagacacaacagcgagccg

SEQ ID NO: 57986 - DNA, 20 bp, Artificial Sequence
  sgRNA
  Slco2b1_5
gattccgcagcagcacccta

SEQ ID NO: 57987 - DNA, 20 bp, Artificial Sequence
  sgRNA
  Slco2b1_6
gatgttgtggaacatcccgc

SEQ ID NO: 57988 - DNA, 20 bp, Artificial Sequence
  sgRNA
  Slco2b1_7
gcaggtcatggtcgtagtag

SEQ ID NO: 57989 - DNA, 20 bp, Artificial Sequence
  sgRNA
  Slco2b1_8
gccccatagccgatcatccg

SEQ ID NO: 57990 - DNA, 20 bp, Artificial Sequence
  sgRNA
  Slco2b1_9
atgttgtggaacatcccgcg

SEQ ID NO: 57991 - DNA, 20 bp, Artificial Sequence
  sgRNA
  Slco2b1_10
ggaacagctgccattggaca

SEQ ID NO: 57992 - DNA, 20 bp, Artificial Sequence
  sgRNA
  Slco2b1_11
gcacagaccctgcttggcat

SEQ ID NO: 57993 - DNA, 20 bp, Artificial Sequence
  sgRNA
  Slco2b1_12
ggtcagggcccagtgaacac

SEQ ID NO: 57994 - DNA, 20 bp, Artificial Sequence
  sgRNA
  Slco2b1_13
tgatgcccacgatgaccaga

SEQ ID NO: 57995 - DNA, 20 bp, Artificial Sequence
  sgRNA
  Slco2b1_14
cacaggtcgtgtcgtccagg

SEQ ID NO: 57996 - DNA, 20 bp, Artificial Sequence
  sgRNA
  Slco2b1_15
cgatgaccagagggatagtg

SEQ ID NO: 57997 - DNA, 20 bp, Artificial Sequence
  sgRNA
  Slco2b1_16
gcgccaccccatcttcttgc

SEQ ID NO: 57998 - DNA, 20 bp, Artificial Sequence
  sgRNA
  Slco2b1_17
gcacgagcctttaaagaaac

SEQ ID NO: 57999 - DNA, 20 bp, Artificial Sequence
  sgRNA
  Slco2b1_18
actatccctctggtcatcgt

SEQ ID NO: 58000 - DNA, 20 bp, Artificial Sequence
  sgRNA
  Slco2b1_19
tggcactgccatggatcaca

SEQ ID NO: 58001 - DNA, 20 bp, Artificial Sequence
  sgRNA
  Slco2b1_20
gctgcagtagactgtgacat

SEQ ID NO: 58002 - DNA, 20 bp, Artificial Sequence
  sgRNA
  Slco3a1_1
taagttacttcggagcacgt

SEQ ID NO: 58003 - DNA, 20 bp, Artificial Sequence
  sgRNA
  Slco3a1_2
gtgcctacctatgtagagcg

SEQ ID NO: 58004 - DNA, 20 bp, Artificial Sequence
  sgRNA
  Slco3a1_3
tgggaacccaaacatcagga

SEQ ID NO: 58005 - DNA, 20 bp, Artificial Sequence
  sgRNA
  Slco3a1_4
gaggctggcgagatccgatg

SEQ ID NO: 58006 - DNA, 20 bp, Artificial Sequence
  sgRNA
  Slco3a1_5
cacccaccagtacaagtacg

SEQ ID NO: 58007 - DNA, 20 bp, Artificial Sequence
  sgRNA
  Slco3a1_6
tcaatataggagacccccag

SEQ ID NO: 58008 - DNA, 20 bp, Artificial Sequence
  sgRNA
  Slco3a1_7
tcatcctctacaccaccacg

SEQ ID NO: 58009 - DNA, 20 bp, Artificial Sequence
  sgRNA
  Slco3a1_8
gctgttccaggtacttgccg

SEQ ID NO: 58010 - DNA, 20 bp, Artificial Sequence
  sgRNA
  Slco3a1_9
gttctggagcaccttctgcg

SEQ ID NO: 58011 - DNA, 20 bp, Artificial Sequence
  sgRNA
  Slco3a1_10
cctatattgacgaccacgtg

SEQ ID NO: 58012 - DNA, 20 bp, Artificial Sequence
  sgRNA
  Slco3a1_11
ttacgaagagaatcagcgcc

SEQ ID NO: 58013 - DNA, 20 bp, Artificial Sequence
  sgRNA
  Slco3a1_12
gtcaatataggagaccccca

SEQ ID NO: 58014 - DNA, 20 bp, Artificial Sequence
  sgRNA
  Slco3a1_13
cgctacatcaaaaaccacga

SEQ ID NO: 58015 - DNA, 20 bp, Artificial Sequence
  sgRNA
  Slco3a1_14
gtaagttacttcggagcacg

SEQ ID NO: 58016 - DNA, 20 bp, Artificial Sequence
  sgRNA
  Slco3a1_15
ggccattcgaatggccccca

SEQ ID NO: 58017 - DNA, 20 bp, Artificial Sequence
  sgRNA
  Slco3a1_16
acgctacatcaaaaaccacg

SEQ ID NO: 58018 - DNA, 20 bp, Artificial Sequence
  sgRNA
  Slco3a1_17
ggtgctccagaacagacagg

SEQ ID NO: 58019 - DNA, 20 bp, Artificial Sequence
  sgRNA
  Slco3a1_18
gctggcgatcacacccacat

SEQ ID NO: 58020 - DNA, 20 bp, Artificial Sequence
  sgRNA
  Slco3a1_19
accaggctccgatccaacgc

SEQ ID NO: 58021 - DNA, 20 bp, Artificial Sequence
  sgRNA
  Slco3a1_20
caccaggctccgatccaacg

SEQ ID NO: 58022 - DNA, 20 bp, Artificial Sequence
  sgRNA
  Slco4a1_1
catccatctctacctcatag

SEQ ID NO: 58023 - DNA, 20 bp, Artificial Sequence
  sgRNA
  Slco4a1_2
gcgctacgttgttatgagag

SEQ ID NO: 58024 - DNA, 20 bp, Artificial Sequence
  sgRNA
  Slco4a1_3
tgaccactgacagcccactg

SEQ ID NO: 58025 - DNA, 20 bp, Artificial Sequence
  sgRNA
  Slco4a1_4
aggtgcagtatgtgtcctcg

SEQ ID NO: 58026 - DNA, 20 bp, Artificial Sequence
  sgRNA
  Slco4a1_5
gctggggcaatgctaccgca

SEQ ID NO: 58027 - DNA, 20 bp, Artificial Sequence
  sgRNA
  Slco4a1_6
gtaaacaagttcaagctccg

SEQ ID NO: 58028 - DNA, 20 bp, Artificial Sequence
  sgRNA
  Slco4a1_7
gccggtacatgctcatcgca

SEQ ID NO: 58029 - DNA, 20 bp, Artificial Sequence
  sgRNA
  Slco4a1_8
agtgtcacacccgctgtccg

SEQ ID NO: 58030 - DNA, 20 bp, Artificial Sequence
  sgRNA
  Slco4a1_9
ggacacatactgcacctcac

SEQ ID NO: 58031 - DNA, 20 bp, Artificial Sequence
  sgRNA
  Slco4a1_10
gtgttcttacgacgatccac

SEQ ID NO: 58032 - DNA, 20 bp, Artificial Sequence
  sgRNA
  Slco4a1_11
gagtagccagacagcccgtg

SEQ ID NO: 58033 - DNA, 20 bp, Artificial Sequence
  sgRNA
  Slco4a1_12
catctctacctcatagcggc

SEQ ID NO: 58034 - DNA, 20 bp, Artificial Sequence
  sgRNA
  Slco4a1_13
ggtagctgtgcagatcgaag

SEQ ID NO: 58035 - DNA, 20 bp, Artificial Sequence
  sgRNA
  Slco4a1_14
attcggtcccaagttcttcg

SEQ ID NO: 58036 - DNA, 20 bp, Artificial Sequence
  sgRNA
  Slco4a1_15
gacgatccactggatcccca

SEQ ID NO: 58037 - DNA, 20 bp, Artificial Sequence
  sgRNA
  Slco4a1_16
ggtggtggtacactcctagg

SEQ ID NO: 58038 - DNA, 20 bp, Artificial Sequence
  sgRNA
  Slco4a1_17
cagcgctaactgctactcta

SEQ ID NO: 58039 - DNA, 20 bp, Artificial Sequence
  sgRNA
  Slco4a1_18
ctggattgctcactgctccg

SEQ ID NO: 58040 - DNA, 20 bp, Artificial Sequence
  sgRNA
  Slco4a1_19
tttcactgccggccgctatg

SEQ ID NO: 58041 - DNA, 20 bp, Artificial Sequence
  sgRNA
  Slco4a1_20
tggatcgtcgtaagaacact

SEQ ID NO: 58042 - DNA, 20 bp, Artificial Sequence
  sgRNA
  Slco4c1_1
ttatagttcggatctgactg

SEQ ID NO: 58043 - DNA, 20 bp, Artificial Sequence
  sgRNA
  Slco4c1_2
acaaagatacgtgcttaaca

SEQ ID NO: 58044 - DNA, 20 bp, Artificial Sequence
  sgRNA
  Slco4c1_3
tttccccttagaatttgatg

SEQ ID NO: 58045 - DNA, 20 bp, Artificial Sequence
  sgRNA
  Slco4c1_4
agagaggacacaaacctcgc

SEQ ID NO: 58046 - DNA, 20 bp, Artificial Sequence
  sgRNA
  Slco4c1_5
tgtctcttagccctaacgca

SEQ ID NO: 58047 - DNA, 20 bp, Artificial Sequence
  sgRNA
  Slco4c1_6
catttcataacgcttctcaa

SEQ ID NO: 58048 - DNA, 20 bp, Artificial Sequence
  sgRNA
  Slco4c1_7
tcaatcctaggccctgccat

SEQ ID NO: 58049 - DNA, 20 bp, Artificial Sequence
  sgRNA
  Slco4c1_8
gggagggcgaagcagacgca

SEQ ID NO: 58050 - DNA, 20 bp, Artificial Sequence
  sgRNA
  Slco4c1_9
gctcttggtcaaatcttagg

SEQ ID NO: 58051 - DNA, 20 bp, Artificial Sequence
  sgRNA
  Slco4c1_10
tgaaagcccctccacccgca

SEQ ID NO: 58052 - DNA, 20 bp, Artificial Sequence
  sgRNA
  Slco4c1_11
cagcttctgatgagccgccg

SEQ ID NO: 58053 - DNA, 20 bp, Artificial Sequence
  sgRNA
  Slco4c1_12
ggtgtgtctgaatcatataa

SEQ ID NO: 58054 - DNA, 20 bp, Artificial Sequence
  sgRNA
  Slco4c1_13
gggacagcaaaaattcaagc

SEQ ID NO: 58055 - DNA, 20 bp, Artificial Sequence
  sgRNA
  Slco4c1_14
gctgggggattcgaagaagg

SEQ ID NO: 58056 - DNA, 20 bp, Artificial Sequence
  sgRNA
  Slco4c1_15
gcctttgcatcctttatgat

SEQ ID NO: 58057 - DNA, 20 bp, Artificial Sequence
  sgRNA
  Slco4c1_16
ggtgtagagcggagtccctc

SEQ ID NO: 58058 - DNA, 20 bp, Artificial Sequence
  sgRNA
  Slco4c1_17
tccacccaacacatatccaa

SEQ ID NO: 58059 - DNA, 20 bp, Artificial Sequence
  sgRNA
  Slco4c1_18
tttaaacaacctgcaaagca

SEQ ID NO: 58060 - DNA, 20 bp, Artificial Sequence
  sgRNA
  Slco4c1_19
tcgcttagctgtgaccccgg

SEQ ID NO: 58061 - DNA, 20 bp, Artificial Sequence
  sgRNA
  Slco4c1_20
gatttatgataacatcaaga

SEQ ID NO: 58062 - DNA, 20 bp, Artificial Sequence
  sgRNA
  Slco5a1_1
taaacatcccttacacaacg

SEQ ID NO: 58063 - DNA, 20 bp, Artificial Sequence
  sgRNA
  Slco5a1_2
gtcatcgtcgataacgacat

SEQ ID NO: 58064 - DNA, 20 bp, Artificial Sequence
  sgRNA
  Slco5a1_3
ctagtaagtatcctactgca

SEQ ID NO: 58065 - DNA, 20 bp, Artificial Sequence
  sgRNA
  Slco5a1_4
tggacttcttattgccatcg

SEQ ID NO: 58066 - DNA, 20 bp, Artificial Sequence
  sgRNA
  Slco5a1_5
agaagcagcgagaatccgta

SEQ ID NO: 58067 - DNA, 20 bp, Artificial Sequence
  sgRNA
  Slco5a1_6
gcagcgcagccagctccgag

SEQ ID NO: 58068 - DNA, 20 bp, Artificial Sequence
  sgRNA
  Slco5a1_7
aaatagtcactggatctacg

SEQ ID NO: 58069 - DNA, 20 bp, Artificial Sequence
  sgRNA
  Slco5a1_8
ttcttcatggacttccccct

SEQ ID NO: 58070 - DNA, 20 bp, Artificial Sequence
  sgRNA
  Slco5a1_9
gctagccatgatctgcagcg

SEQ ID NO: 58071 - DNA, 20 bp, Artificial Sequence
  sgRNA
  Slco5a1_10
gttggtcccagggtgtaaat

SEQ ID NO: 58072 - DNA, 20 bp, Artificial Sequence
  sgRNA
  Slco5a1_11
ggagagaaggtgtctctacg

SEQ ID NO: 58073 - DNA, 20 bp, Artificial Sequence
  sgRNA
  Slco5a1_12
gtgtcatcaccaccatcgaa

SEQ ID NO: 58074 - DNA, 20 bp, Artificial Sequence
  sgRNA
  Slco5a1_13
catggactgtaaccacagga

SEQ ID NO: 58075 - DNA, 20 bp, Artificial Sequence
  sgRNA
  Slco5a1_14
gtgtctctacgtggtcctta

SEQ ID NO: 58076 - DNA, 20 bp, Artificial Sequence
  sgRNA
  Slco5a1_15
atttggagcctcatgaacaa

SEQ ID NO: 58077 - DNA, 20 bp, Artificial Sequence
  sgRNA
  Slco5a1_16
aatccaagagttgaacgctt

SEQ ID NO: 58078 - DNA, 20 bp, Artificial Sequence
  sgRNA
  Slco5a1_17
actcgggaggaaatagtcac

SEQ ID NO: 58079 - DNA, 20 bp, Artificial Sequence
  sgRNA
  Slco5a1_18
acccagagaccattaacgcc

SEQ ID NO: 58080 - DNA, 20 bp, Artificial Sequence
  sgRNA
  Slco5a1_19
ctagaggcaccgtcttcggt

SEQ ID NO: 58081 - DNA, 20 bp, Artificial Sequence
  sgRNA
  Slco5a1_20
tctgctccatccacttcggc

SEQ ID NO: 58082 - DNA, 20 bp, Artificial Sequence
  sgRNA
  Slco6c1_1
gtgtaccaactgttgcagag

SEQ ID NO: 58083 - DNA, 20 bp, Artificial Sequence
  sgRNA
  Slco6c1_2
acatatgaaattataatacc

SEQ ID NO: 58084 - DNA, 20 bp, Artificial Sequence
  sgRNA
  Slco6c1_3
agtgtatccatggcatagca

SEQ ID NO: 58085 - DNA, 20 bp, Artificial Sequence
  sgRNA
  Slco6c1_4
aacaacagttcggcacttgt

SEQ ID NO: 58086 - DNA, 20 bp, Artificial Sequence
  sgRNA
  Slco6c1_5
gtatctatttccacatcgct

SEQ ID NO: 58087 - DNA, 20 bp, Artificial Sequence
  sgRNA
  Slco6c1_6
gtcctcctaccatacccaga

SEQ ID NO: 58088 - DNA, 20 bp, Artificial Sequence
  sgRNA
  Slco6c1_7
gcttccaaggaggggccact

SEQ ID NO: 58089 - DNA, 20 bp, Artificial Sequence
  sgRNA
  Slco6c1_8
aacttcacttcacttagcct

SEQ ID NO: 58090 - DNA, 20 bp, Artificial Sequence
  sgRNA
  Slco6c1_9
ggacattctgcatatctgat

SEQ ID NO: 58091 - DNA, 20 bp, Artificial Sequence
  sgRNA
  Slco6c1_10
gcgaacttcttcttggcaat

SEQ ID NO: 58092 - DNA, 20 bp, Artificial Sequence
  sgRNA
  Slco6c1_11
gggacaataatagatgtgga

SEQ ID NO: 58093 - DNA, 20 bp, Artificial Sequence
  sgRNA
  Slco6c1_12
ttaagtctcctgtcaatggt

SEQ ID NO: 58094 - DNA, 20 bp, Artificial Sequence
  sgRNA
  Slco6c1_13
tagcacactttggaagtaaa

SEQ ID NO: 58095 - DNA, 20 bp, Artificial Sequence
  sgRNA
  Slco6c1_14
ctaagtgaagtgaagttggc

SEQ ID NO: 58096 - DNA, 20 bp, Artificial Sequence
  sgRNA
  Slco6c1_15
gtacttcctggaggcataat

SEQ ID NO: 58097 - DNA, 20 bp, Artificial Sequence
  sgRNA
  Slco6c1_16
agtctcctgtcaatggtggg

SEQ ID NO: 58098 - DNA, 20 bp, Artificial Sequence
  sgRNA
  Slco6c1_17
gggaatgtggtcaaaaatga

SEQ ID NO: 58099 - DNA, 20 bp, Artificial Sequence
  sgRNA
  Slco6c1_18
atattggtctacgaatttat

SEQ ID NO: 58100 - DNA, 20 bp, Artificial Sequence
  sgRNA
  Slco6c1_19
tggaggataattgagatgac

SEQ ID NO: 58101 - DNA, 20 bp, Artificial Sequence
  sgRNA
  Slco6c1_20
actatagggcccaaaccaag

SEQ ID NO: 58102 - DNA, 20 bp, Artificial Sequence
  sgRNA
  Slco6d1_1
aggattcgaatactgcagcg

SEQ ID NO: 58103 - DNA, 20 bp, Artificial Sequence
  sgRNA
  Slco6d1_2
tcagtctataaaactttacg

SEQ ID NO: 58104 - DNA, 20 bp, Artificial Sequence
  sgRNA
  Slco6d1_3
ttatttaaaagagttgtgcg

SEQ ID NO: 58105 - DNA, 20 bp, Artificial Sequence
  sgRNA
  Slco6d1_4
caaaccatatggctcctccg

SEQ ID NO: 58106 - DNA, 20 bp, Artificial Sequence
  sgRNA
  Slco6d1_5
ctacttgggacagcaccagt

SEQ ID NO: 58107 - DNA, 20 bp, Artificial Sequence
  sgRNA
  Slco6d1_6
gctccatgcaatgtgccctg

SEQ ID NO: 58108 - DNA, 20 bp, Artificial Sequence
  sgRNA
  Slco6d1_7
tcgaaaatacaaagatccct

SEQ ID NO: 58109 - DNA, 20 bp, Artificial Sequence
  sgRNA
  Slco6d1_8
gcaaacttcttcactgcagt

SEQ ID NO: 58110 - DNA, 20 bp, Artificial Sequence
  sgRNA
  Slco6d1_9
gctcttgtagatgctgcact

SEQ ID NO: 58111 - DNA, 20 bp, Artificial Sequence
  sgRNA
  Slco6d1_10
gcacattgcatggagctgtg

SEQ ID NO: 58112 - DNA, 20 bp, Artificial Sequence
  sgRNA
  Slco6d1_11
ttaagtctcctgtcaaaggt

SEQ ID NO: 58113 - DNA, 20 bp, Artificial Sequence
  sgRNA
  Slco6d1_12
agtctcctgtcaaaggtagg

SEQ ID NO: 58114 - DNA, 20 bp, Artificial Sequence
  sgRNA
  Slco6d1_13
tgaatgacaatcaaggcgga

SEQ ID NO: 58115 - DNA, 20 bp, Artificial Sequence
  sgRNA
  Slco6d1_14
tgtacaactttaccactgtt

SEQ ID NO: 58116 - DNA, 20 bp, Artificial Sequence
  sgRNA
  Slco6d1_15
gtgagcatagaggcacttga

SEQ ID NO: 58117 - DNA, 20 bp, Artificial Sequence
  sgRNA
  Slco6d1_16
atggcaagcctgctattcca

SEQ ID NO: 58118 - DNA, 20 bp, Artificial Sequence
  sgRNA
  Slco6d1_17
gtagatgctgcactaggggt

SEQ ID NO: 58119 - DNA, 20 bp, Artificial Sequence
  sgRNA
  Slco6d1_18
aaaccatatggctcctccga

SEQ ID NO: 58120 - DNA, 20 bp, Artificial Sequence
  sgRNA
  Slco6d1_19
gatccctcggaggagccata

SEQ ID NO: 58121 - DNA, 20 bp, Artificial Sequence
  sgRNA
  Slco6d1_20
ctgcagttggaagtgttacc

SEQ ID NO: 58122 - DNA, 20 bp, Artificial Sequence
  sgRNA
  Slitrk1_1
tattacgggatatagacccg

SEQ ID NO: 58123 - DNA, 20 bp, Artificial Sequence
  sgRNA
  Slitrk1_2
gcttgcatgagatcgttccg

SEQ ID NO: 58124 - DNA, 20 bp, Artificial Sequence
  sgRNA
  Slitrk1_3
aaacgccctaatcggtcgag

SEQ ID NO: 58125 - DNA, 20 bp, Artificial Sequence
  sgRNA
  Slitrk1_4
tcctgcacgttggaaagctt

SEQ ID NO: 58126 - DNA, 20 bp, Artificial Sequence
  sgRNA
  Slitrk1_5
ttatcctgaggaaccgaaag

SEQ ID NO: 58127 - DNA, 20 bp, Artificial Sequence
  sgRNA
  Slitrk1_6
ttactgtgcgaagttaacgt

SEQ ID NO: 58128 - DNA, 20 bp, Artificial Sequence
  sgRNA
  Slitrk1_7
gcatggcattgaaagtacca

SEQ ID NO: 58129 - DNA, 20 bp, Artificial Sequence
  sgRNA
  Slitrk1_8
ggatgagcatgctaccccag

SEQ ID NO: 58130 - DNA, 20 bp, Artificial Sequence
  sgRNA
  Slitrk1_9
gccacagtcatacaccctat

SEQ ID NO: 58131 - DNA, 20 bp, Artificial Sequence
  sgRNA
  Slitrk1_10
tcaatgccatgccgaaactg

SEQ ID NO: 58132 - DNA, 20 bp, Artificial Sequence
  sgRNA
  Slitrk1_11
gtttccacggaggtcgaggt

SEQ ID NO: 58133 - DNA, 20 bp, Artificial Sequence
  sgRNA
  Slitrk1_12
attacgggatatagacccgg

SEQ ID NO: 58134 - DNA, 20 bp, Artificial Sequence
  sgRNA
  Slitrk1_13
cttgcatgagatcgttccgg

SEQ ID NO: 58135 - DNA, 20 bp, Artificial Sequence
  sgRNA
  Slitrk1_14
gcatgctcgtgtttatcctg

SEQ ID NO: 58136 - DNA, 20 bp, Artificial Sequence
  sgRNA
  Slitrk1_15
actcctacctagacaccagc

SEQ ID NO: 58137 - DNA, 20 bp, Artificial Sequence
  sgRNA
  Slitrk1_16
agatcctcgcatacagctgg

SEQ ID NO: 58138 - DNA, 20 bp, Artificial Sequence
  sgRNA
  Slitrk1_17
gtaaaactgggaagtcgggg

SEQ ID NO: 58139 - DNA, 20 bp, Artificial Sequence
  sgRNA
  Slitrk1_18
tcatctttaagcctgagcct

SEQ ID NO: 58140 - DNA, 20 bp, Artificial Sequence
  sgRNA
  Slitrk1_19
gatcacaggtgcagtcccaa

SEQ ID NO: 58141 - DNA, 20 bp, Artificial Sequence
  sgRNA
  Slitrk1_20
acaatgcagatgggtcccat

SEQ ID NO: 58142 - DNA, 20 bp, Artificial Sequence
  sgRNA
  Slitrk2_1
ctgactcacttagacctgag

SEQ ID NO: 58143 - DNA, 20 bp, Artificial Sequence
  sgRNA
  Slitrk2_2
caaactggaggtattgcgag

SEQ ID NO: 58144 - DNA, 20 bp, Artificial Sequence
  sgRNA
  Slitrk2_3
gaggttaatcaaagcatcaa

SEQ ID NO: 58145 - DNA, 20 bp, Artificial Sequence
  sgRNA
  Slitrk2_4
ctgatagatgcgatactggg

SEQ ID NO: 58146 - DNA, 20 bp, Artificial Sequence
  sgRNA
  Slitrk2_5
gtaccagaccaagtcccccg

SEQ ID NO: 58147 - DNA, 20 bp, Artificial Sequence
  sgRNA
  Slitrk2_6
gctgatagatgcgatactgg

SEQ ID NO: 58148 - DNA, 20 bp, Artificial Sequence
  sgRNA
  Slitrk2_7
agatctgcaagagaacccat

SEQ ID NO: 58149 - DNA, 20 bp, Artificial Sequence
  sgRNA
  Slitrk2_8
gttcctcagtgtgttaacag

SEQ ID NO: 58150 - DNA, 20 bp, Artificial Sequence
  sgRNA
  Slitrk2_9
tgatagatgcgatactgggg

SEQ ID NO: 58151 - DNA, 20 bp, Artificial Sequence
  sgRNA
  Slitrk2_10
gagtgactgtgtcaaaagac

SEQ ID NO: 58152 - DNA, 20 bp, Artificial Sequence
  sgRNA
  Slitrk2_11
ctcttcatctaggtaacaat

SEQ ID NO: 58153 - DNA, 20 bp, Artificial Sequence
  sgRNA
  Slitrk2_12
ttacgaagactttatctgaa

SEQ ID NO: 58154 - DNA, 20 bp, Artificial Sequence
  sgRNA
  Slitrk2_13
ggtgtccttgaacatattgg

SEQ ID NO: 58155 - DNA, 20 bp, Artificial Sequence
  sgRNA
  Slitrk2_14
actgcaagctaaaccgcaat

SEQ ID NO: 58156 - DNA, 20 bp, Artificial Sequence
  sgRNA
  Slitrk2_15
gcgtcgagattcatatgaag

SEQ ID NO: 58157 - DNA, 20 bp, Artificial Sequence
  sgRNA
  Slitrk2_16
gtttagcttgcagtaaaggg

SEQ ID NO: 58158 - DNA, 20 bp, Artificial Sequence
  sgRNA
  Slitrk2_17
gctgactcacttagacctga

SEQ ID NO: 58159 - DNA, 20 bp, Artificial Sequence
  sgRNA
  Slitrk2_18
actgcacctgtgacatcatg

SEQ ID NO: 58160 - DNA, 20 bp, Artificial Sequence
  sgRNA
  Slitrk2_19
gatttcggtaataggccact

SEQ ID NO: 58161 - DNA, 20 bp, Artificial Sequence
  sgRNA
  Slitrk2_20
cctcaataacaacaaactgg

SEQ ID NO: 58162 - DNA, 20 bp, Artificial Sequence
  sgRNA
  Slitrk3_1
caatagtgcgcacatcacgg

SEQ ID NO: 58163 - DNA, 20 bp, Artificial Sequence
  sgRNA
  Slitrk3_2
acctcagagtcagacaacag

SEQ ID NO: 58164 - DNA, 20 bp, Artificial Sequence
  sgRNA
  Slitrk3_3
aaaaattccaaaaatcagag

SEQ ID NO: 58165 - DNA, 20 bp, Artificial Sequence
  sgRNA
  Slitrk3_4
gggtggtctagtctgatagg

SEQ ID NO: 58166 - DNA, 20 bp, Artificial Sequence
  sgRNA
  Slitrk3_5
gcaacttcttcctacgccga

SEQ ID NO: 58167 - DNA, 20 bp, Artificial Sequence
  sgRNA
  Slitrk3_6
ggagattaccaccctaacgg

SEQ ID NO: 58168 - DNA, 20 bp, Artificial Sequence
  sgRNA
  Slitrk3_7
tggagattaccaccctaacg

SEQ ID NO: 58169 - DNA, 20 bp, Artificial Sequence
  sgRNA
  Slitrk3_8
atactcgtacacgtgaccca

SEQ ID NO: 58170 - DNA, 20 bp, Artificial Sequence
  sgRNA
  Slitrk3_9
aaaccccaccaactgccgag

SEQ ID NO: 58171 - DNA, 20 bp, Artificial Sequence
  sgRNA
  Slitrk3_10
aatagtgcgcacatcacggt

SEQ ID NO: 58172 - DNA, 20 bp, Artificial Sequence
  sgRNA
  Slitrk3_11
acggtgggtgaggttctcgg

SEQ ID NO: 58173 - DNA, 20 bp, Artificial Sequence
  sgRNA
  Slitrk3_12
acaggtaatgtctcccacca

SEQ ID NO: 58174 - DNA, 20 bp, Artificial Sequence
  sgRNA
  Slitrk3_13
cctacgccgacggagcacat

SEQ ID NO: 58175 - DNA, 20 bp, Artificial Sequence
  sgRNA
  Slitrk3_14
ctgactccaggtatgttccg

SEQ ID NO: 58176 - DNA, 20 bp, Artificial Sequence
  sgRNA
  Slitrk3_15
gtagttactgtggttctcct

SEQ ID NO: 58177 - DNA, 20 bp, Artificial Sequence
  sgRNA
  Slitrk3_16
tcaacttaacaccatagtga

SEQ ID NO: 58178 - DNA, 20 bp, Artificial Sequence
  sgRNA
  Slitrk3_17
ataccttacacagccctggt

SEQ ID NO: 58179 - DNA, 20 bp, Artificial Sequence
  sgRNA
  Slitrk3_18
tcggaacctaagtaaattga

SEQ ID NO: 58180 - DNA, 20 bp, Artificial Sequence
  sgRNA
  Slitrk3_19
ggtcctggtacacaaccaac

SEQ ID NO: 58181 - DNA, 20 bp, Artificial Sequence
  sgRNA
  Slitrk3_20
ccagagaaagcccctcccgt

SEQ ID NO: 58182 - DNA, 20 bp, Artificial Sequence
  sgRNA
  Slitrk4_1
aagcaagaactatgccccat

SEQ ID NO: 58183 - DNA, 20 bp, Artificial Sequence
  sgRNA
  Slitrk4_2
agatgatagaaattagacca

SEQ ID NO: 58184 - DNA, 20 bp, Artificial Sequence
  sgRNA
  Slitrk4_3
ctttaatgctaccaagtcgc

SEQ ID NO: 58185 - DNA, 20 bp, Artificial Sequence
  sgRNA
  Slitrk4_4
ttaatcaagtatattgaacg

SEQ ID NO: 58186 - DNA, 20 bp, Artificial Sequence
  sgRNA
  Slitrk4_5
ttaacccatttggatatacg

SEQ ID NO: 58187 - DNA, 20 bp, Artificial Sequence
  sgRNA
  Slitrk4_6
gagttcccccgactacctac

SEQ ID NO: 58188 - DNA, 20 bp, Artificial Sequence
  sgRNA
  Slitrk4_7
tgaaggtaattgcaggcgca

SEQ ID NO: 58189 - DNA, 20 bp, Artificial Sequence
  sgRNA
  Slitrk4_8
acaatcttactaatctgcgc

SEQ ID NO: 58190 - DNA, 20 bp, Artificial Sequence
  sgRNA
  Slitrk4_9
gtaaaattgttgttgaacaa

SEQ ID NO: 58191 - DNA, 20 bp, Artificial Sequence
  sgRNA
  Slitrk4_10
tgtttcctcgtatatccaaa

SEQ ID NO: 58192 - DNA, 20 bp, Artificial Sequence
  sgRNA
  Slitrk4_11
aaggacctgtaggtagtcgg

SEQ ID NO: 58193 - DNA, 20 bp, Artificial Sequence
  sgRNA
  Slitrk4_12
cctattcgaagtcctcctgg

SEQ ID NO: 58194 - DNA, 20 bp, Artificial Sequence
  sgRNA
  Slitrk4_13
agttctagaacacattggcc

SEQ ID NO: 58195 - DNA, 20 bp, Artificial Sequence
  sgRNA
  Slitrk4_14
aagtcactgcctgtacccat

SEQ ID NO: 58196 - DNA, 20 bp, Artificial Sequence
  sgRNA
  Slitrk4_15
actggacaaggtgtaagagg

SEQ ID NO: 58197 - DNA, 20 bp, Artificial Sequence
  sgRNA
  Slitrk4_16
tgatcaagtactccgctgac

SEQ ID NO: 58198 - DNA, 20 bp, Artificial Sequence
  sgRNA
  Slitrk4_17
cagacttcactgagtttgag

SEQ ID NO: 58199 - DNA, 20 bp, Artificial Sequence
  sgRNA
  Slitrk4_18
ctcaggttcagtctagcaag

SEQ ID NO: 58200 - DNA, 20 bp, Artificial Sequence
  sgRNA
  Slitrk4_19
ggagtggtgaaggtaattgc

SEQ ID NO: 58201 - DNA, 20 bp, Artificial Sequence
  sgRNA
  Slitrk4_20
tgacttagagggcaaccctt

SEQ ID NO: 58202 - DNA, 20 bp, Artificial Sequence
  sgRNA
  Slitrk5_1
ggtggtatgtagataccccg

SEQ ID NO: 58203 - DNA, 20 bp, Artificial Sequence
  sgRNA
  Slitrk5_2
aattcgcagagacctacatg

SEQ ID NO: 58204 - DNA, 20 bp, Artificial Sequence
  sgRNA
  Slitrk5_3
aggtgatagattgggaaacg

SEQ ID NO: 58205 - DNA, 20 bp, Artificial Sequence
  sgRNA
  Slitrk5_4
aggttgcaagtacatgctgt

SEQ ID NO: 58206 - DNA, 20 bp, Artificial Sequence
  sgRNA
  Slitrk5_5
gatttccccataataatcga

SEQ ID NO: 58207 - DNA, 20 bp, Artificial Sequence
  sgRNA
  Slitrk5_6
cgtcgcaggtacaatcccaa

SEQ ID NO: 58208 - DNA, 20 bp, Artificial Sequence
  sgRNA
  Slitrk5_7
ctacaaagacagcacccgga

SEQ ID NO: 58209 - DNA, 20 bp, Artificial Sequence
  sgRNA
  Slitrk5_8
gtattcatacacgtggcccg

SEQ ID NO: 58210 - DNA, 20 bp, Artificial Sequence
  sgRNA
  Slitrk5_9
actgtgagctgtgaaaaccg

SEQ ID NO: 58211 - DNA, 20 bp, Artificial Sequence
  sgRNA
  Slitrk5_10
ccaaatccctgccgtgtaga

SEQ ID NO: 58212 - DNA, 20 bp, Artificial Sequence
  sgRNA
  Slitrk5_11
ttaactccaggtactcgttc

SEQ ID NO: 58213 - DNA, 20 bp, Artificial Sequence
  sgRNA
  Slitrk5_12
agttcacaggagcaattcca

SEQ ID NO: 58214 - DNA, 20 bp, Artificial Sequence
  sgRNA
  Slitrk5_13
ttgggattgtacctgcgacg

SEQ ID NO: 58215 - DNA, 20 bp, Artificial Sequence
  sgRNA
  Slitrk5_14
gagacccccttccgtctaca

SEQ ID NO: 58216 - DNA, 20 bp, Artificial Sequence
  sgRNA
  Slitrk5_15
gtctcgagaaggcaattccg

SEQ ID NO: 58217 - DNA, 20 bp, Artificial Sequence
  sgRNA
  Slitrk5_16
ggttctacaaagacagcacc

SEQ ID NO: 58218 - DNA, 20 bp, Artificial Sequence
  sgRNA
  Slitrk5_17
gcccaaggtgaagactcccg

SEQ ID NO: 58219 - DNA, 20 bp, Artificial Sequence
  sgRNA
  Slitrk5_18
tgtgcaagaaccccatctac

SEQ ID NO: 58220 - DNA, 20 bp, Artificial Sequence
  sgRNA
  Slitrk5_19
tctacaaagacagcacccgg

SEQ ID NO: 58221 - DNA, 20 bp, Artificial Sequence
  sgRNA
  Slitrk5_20
gaaggtttccagacaacaag

SEQ ID NO: 58222 - DNA, 20 bp, Artificial Sequence
  sgRNA
  Slitrk6_1
tttgtatcttgagtacaatg

SEQ ID NO: 58223 - DNA, 20 bp, Artificial Sequence
  sgRNA
  Slitrk6_2
ccaattggaggacaataagt

SEQ ID NO: 58224 - DNA, 20 bp, Artificial Sequence
  sgRNA
  Slitrk6_3
cttaagtggaaaggtcgtga

SEQ ID NO: 58225 - DNA, 20 bp, Artificial Sequence
  sgRNA
  Slitrk6_4
atgtattcttgcttgatagg

SEQ ID NO: 58226 - DNA, 20 bp, Artificial Sequence
  sgRNA
  Slitrk6_5
agtggataagaagccccgaa

SEQ ID NO: 58227 - DNA, 20 bp, Artificial Sequence
  sgRNA
  Slitrk6_6
gacaaaaaccacgatccccg

SEQ ID NO: 58228 - DNA, 20 bp, Artificial Sequence
  sgRNA
  Slitrk6_7
ctattgtattctgtgccgcg

SEQ ID NO: 58229 - DNA, 20 bp, Artificial Sequence
  sgRNA
  Slitrk6_8
agtcacaagagcagtcccag

SEQ ID NO: 58230 - DNA, 20 bp, Artificial Sequence
  sgRNA
  Slitrk6_9
gttcccacgaagatctagat

SEQ ID NO: 58231 - DNA, 20 bp, Artificial Sequence
  sgRNA
  Slitrk6_10
tcttatatcttctcctacgg

SEQ ID NO: 58232 - DNA, 20 bp, Artificial Sequence
  sgRNA
  Slitrk6_11
aaggattattcactaaacca

SEQ ID NO: 58233 - DNA, 20 bp, Artificial Sequence
  sgRNA
  Slitrk6_12
ggttcccacgaagatctaga

SEQ ID NO: 58234 - DNA, 20 bp, Artificial Sequence
  sgRNA
  Slitrk6_13
tgaccttgaggataacccct

SEQ ID NO: 58235 - DNA, 20 bp, Artificial Sequence
  sgRNA
  Slitrk6_14
tcatgctcttcgtatactgg

SEQ ID NO: 58236 - DNA, 20 bp, Artificial Sequence
  sgRNA
  Slitrk6_15
gcaaagaagatcactgttga

SEQ ID NO: 58237 - DNA, 20 bp, Artificial Sequence
  sgRNA
  Slitrk6_16
cctcacagactatttcactt

SEQ ID NO: 58238 - DNA, 20 bp, Artificial Sequence
  sgRNA
  Slitrk6_17
attccaggttctccaaacca

SEQ ID NO: 58239 - DNA, 20 bp, Artificial Sequence
  sgRNA
  Slitrk6_18
agtacactccctttgaaagg

SEQ ID NO: 58240 - DNA, 20 bp, Artificial Sequence
  sgRNA
  Slitrk6_19
cgttgatgtactcacgacca

SEQ ID NO: 58241 - DNA, 20 bp, Artificial Sequence
  sgRNA
  Slitrk6_20
acagccctccacctttcaaa

SEQ ID NO: 58242 - DNA, 20 bp, Artificial Sequence
  sgRNA
  Smo_1
gaactccaatcgctaccctg

SEQ ID NO: 58243 - DNA, 20 bp, Artificial Sequence
  sgRNA
  Smo_2
tcagaacccgctgttcaccg

SEQ ID NO: 58244 - DNA, 20 bp, Artificial Sequence
  sgRNA
  Smo_3
caagtgtgagaatgaccgag

SEQ ID NO: 58245 - DNA, 20 bp, Artificial Sequence
  sgRNA
  Smo_4
gtagatggagactccgtgag

SEQ ID NO: 58246 - DNA, 20 bp, Artificial Sequence
  sgRNA
  Smo_5
catagaagagaataaccgca

SEQ ID NO: 58247 - DNA, 20 bp, Artificial Sequence
  sgRNA
  Smo_6
agcgtggtggtggctccgta

SEQ ID NO: 58248 - DNA, 20 bp, Artificial Sequence
  sgRNA
  Smo_7
tgactttctgcgttgcacac

SEQ ID NO: 58249 - DNA, 20 bp, Artificial Sequence
  sgRNA
  Smo_8
aggcacacgttgtagcgcaa

SEQ ID NO: 58250 - DNA, 20 bp, Artificial Sequence
  sgRNA
  Smo_9
gggttgtctgttcgcaccaa

SEQ ID NO: 58251 - DNA, 20 bp, Artificial Sequence
  sgRNA
  Smo_10
gagaccagtgaccgccccga

SEQ ID NO: 58252 - DNA, 20 bp, Artificial Sequence
  sgRNA
  Smo_11
ggtgcgcctccagatgagca

SEQ ID NO: 58253 - DNA, 20 bp, Artificial Sequence
  sgRNA
  Smo_12
tgctcggcctcggtgaacag

SEQ ID NO: 58254 - DNA, 20 bp, Artificial Sequence
  sgRNA
  Smo_13
ccaagatctcagcctccatt

SEQ ID NO: 58255 - DNA, 20 bp, Artificial Sequence
  sgRNA
  Smo_14
ggatgtgtccgttacccctg

SEQ ID NO: 58256 - DNA, 20 bp, Artificial Sequence
  sgRNA
  Smo_15
cttgcccgagagaggctggt

SEQ ID NO: 58257 - DNA, 20 bp, Artificial Sequence
  sgRNA
  Smo_16
gatcactgcccagcagcggg

SEQ ID NO: 58258 - DNA, 20 bp, Artificial Sequence
  sgRNA
  Smo_17
tgggccggaagaaaaagcgg

SEQ ID NO: 58259 - DNA, 20 bp, Artificial Sequence
  sgRNA
  Smo_18
gactcgcaggaggaagcgca

SEQ ID NO: 58260 - DNA, 20 bp, Artificial Sequence
  sgRNA
  Smo_19
aggcagcccgatggtcacgt

SEQ ID NO: 58261 - DNA, 20 bp, Artificial Sequence
  sgRNA
  Smo_20
tgtagcgcaaaggctcgcag

SEQ ID NO: 58262 - DNA, 20 bp, Artificial Sequence
  sgRNA
  Sorcs1_1
acgaggagtctacttcacac

SEQ ID NO: 58263 - DNA, 20 bp, Artificial Sequence
  sgRNA
  Sorcs1_2
tttcccaggttacatcgacc

SEQ ID NO: 58264 - DNA, 20 bp, Artificial Sequence
  sgRNA
  Sorcs1_3
agctctatgactataacctg

SEQ ID NO: 58265 - DNA, 20 bp, Artificial Sequence
  sgRNA
  Sorcs1_4
tgaaggtgtagcgaacagta

SEQ ID NO: 58266 - DNA, 20 bp, Artificial Sequence
  sgRNA
  Sorcs1_5
gcaatgatcccggatgtgta

SEQ ID NO: 58267 - DNA, 20 bp, Artificial Sequence
  sgRNA
  Sorcs1_6
catcctttagcatgtcccgg

SEQ ID NO: 58268 - DNA, 20 bp, Artificial Sequence
  sgRNA
  Sorcs1_7
ctcgctccagaaacagcgca

SEQ ID NO: 58269 - DNA, 20 bp, Artificial Sequence
  sgRNA
  Sorcs1_8
gaaacagcgcacggtccccg

SEQ ID NO: 58270 - DNA, 20 bp, Artificial Sequence
  sgRNA
  Sorcs1_9
gcagcttatccaggaatcag

SEQ ID NO: 58271 - DNA, 20 bp, Artificial Sequence
  sgRNA
  Sorcs1_10
aatcggagagatgagtcacc

SEQ ID NO: 58272 - DNA, 20 bp, Artificial Sequence
  sgRNA
  Sorcs1_11
aggactccatccacaaagag

SEQ ID NO: 58273 - DNA, 20 bp, Artificial Sequence
  sgRNA
  Sorcs1_12
gtatcaccgagagctcgctt

SEQ ID NO: 58274 - DNA, 20 bp, Artificial Sequence
  sgRNA
  Sorcs1_13
cctacggccagagcgtgcag

SEQ ID NO: 58275 - DNA, 20 bp, Artificial Sequence
  sgRNA
  Sorcs1_14
gtgcacttcgagctgaagcc

SEQ ID NO: 58276 - DNA, 20 bp, Artificial Sequence
  sgRNA
  Sorcs1_15
acttcagtcatcgttccgaa

SEQ ID NO: 58277 - DNA, 20 bp, Artificial Sequence
  sgRNA
  Sorcs1_16
cttggggtaagggtccggcg

SEQ ID NO: 58278 - DNA, 20 bp, Artificial Sequence
  sgRNA
  Sorcs1_17
gacaatccgcagcccacgag

SEQ ID NO: 58279 - DNA, 20 bp, Artificial Sequence
  sgRNA
  Sorcs1_18
catgagacccctgttcgcag

SEQ ID NO: 58280 - DNA, 20 bp, Artificial Sequence
  sgRNA
  Sorcs1_19
tttccgagtgaccgtgcagg

SEQ ID NO: 58281 - DNA, 20 bp, Artificial Sequence
  sgRNA
  Sorcs1_20
gctccagatgcagatctaag

SEQ ID NO: 58282 - DNA, 20 bp, Artificial Sequence
  sgRNA
  Sorcs2_1
gggaatagcgaaccccacgc

SEQ ID NO: 58283 - DNA, 20 bp, Artificial Sequence
  sgRNA
  Sorcs2_2
gtaccgtgcctgacacatag

SEQ ID NO: 58284 - DNA, 20 bp, Artificial Sequence
  sgRNA
  Sorcs2_3
gtaggttgtcccaaaatctg

SEQ ID NO: 58285 - DNA, 20 bp, Artificial Sequence
  sgRNA
  Sorcs2_4
caacccatccacgaacactg

SEQ ID NO: 58286 - DNA, 20 bp, Artificial Sequence
  sgRNA
  Sorcs2_5
cgacccaaacttggtccacg

SEQ ID NO: 58287 - DNA, 20 bp, Artificial Sequence
  sgRNA
  Sorcs2_6
acagtcataacctacaacaa

SEQ ID NO: 58288 - DNA, 20 bp, Artificial Sequence
  sgRNA
  Sorcs2_7
gcgataggagacatagtact

SEQ ID NO: 58289 - DNA, 20 bp, Artificial Sequence
  sgRNA
  Sorcs2_8
cctgcaggccctctacctcg

SEQ ID NO: 58290 - DNA, 20 bp, Artificial Sequence
  sgRNA
  Sorcs2_9
gtaccagtcagacctgcgtg

SEQ ID NO: 58291 - DNA, 20 bp, Artificial Sequence
  sgRNA
  Sorcs2_10
tcatcctcgccacactgccg

SEQ ID NO: 58292 - DNA, 20 bp, Artificial Sequence
  sgRNA
  Sorcs2_11
cacgaacgtggccagcacgg

SEQ ID NO: 58293 - DNA, 20 bp, Artificial Sequence
  sgRNA
  Sorcs2_12
agcacgtcgttcgtgctcaa

SEQ ID NO: 58294 - DNA, 20 bp, Artificial Sequence
  sgRNA
  Sorcs2_13
tgaccagctcccagtcagag

SEQ ID NO: 58295 - DNA, 20 bp, Artificial Sequence
  sgRNA
  Sorcs2_14
tgtcattggcgtcaaccagg

SEQ ID NO: 58296 - DNA, 20 bp, Artificial Sequence
  sgRNA
  Sorcs2_15
gcgcagctcgaggcaagccg

SEQ ID NO: 58297 - DNA, 20 bp, Artificial Sequence
  sgRNA
  Sorcs2_16
tctccggccccattgaccgc

SEQ ID NO: 58298 - DNA, 20 bp, Artificial Sequence
  sgRNA
  Sorcs2_17
gtttgagcgctcatcttcct

SEQ ID NO: 58299 - DNA, 20 bp, Artificial Sequence
  sgRNA
  Sorcs2_18
ggtgcctctgcggttctcca

SEQ ID NO: 58300 - DNA, 20 bp, Artificial Sequence
  sgRNA
  Sorcs2_19
cctgcacctgcacttgcggt

SEQ ID NO: 58301 - DNA, 20 bp, Artificial Sequence
  sgRNA
  Sorcs2_20
gcgtggggttcgctattccc

SEQ ID NO: 58302 - DNA, 20 bp, Artificial Sequence
  sgRNA
  Sorcs3_1
tcacaccaagggttcgcgag

SEQ ID NO: 58303 - DNA, 20 bp, Artificial Sequence
  sgRNA
  Sorcs3_2
ccagtccagacaccgacctg

SEQ ID NO: 58304 - DNA, 20 bp, Artificial Sequence
  sgRNA
  Sorcs3_3
cttcagtccgtatctccccg

SEQ ID NO: 58305 - DNA, 20 bp, Artificial Sequence
  sgRNA
  Sorcs3_4
acgtgggatctactttaccc

SEQ ID NO: 58306 - DNA, 20 bp, Artificial Sequence
  sgRNA
  Sorcs3_5
actatcccaggcgagccgcg

SEQ ID NO: 58307 - DNA, 20 bp, Artificial Sequence
  sgRNA
  Sorcs3_6
gacccgggaacacagccacg

SEQ ID NO: 58308 - DNA, 20 bp, Artificial Sequence
  sgRNA
  Sorcs3_7
agccgacgaataccaccgag

SEQ ID NO: 58309 - DNA, 20 bp, Artificial Sequence
  sgRNA
  Sorcs3_8
tctacatctcagacacacgt

SEQ ID NO: 58310 - DNA, 20 bp, Artificial Sequence
  sgRNA
  Sorcs3_9
acttcagcctgcgctccgaa

SEQ ID NO: 58311 - DNA, 20 bp, Artificial Sequence
  sgRNA
  Sorcs3_10
ggcatgtgtataagagcgcg

SEQ ID NO: 58312 - DNA, 20 bp, Artificial Sequence
  sgRNA
  Sorcs3_11
ccactatcccaggcgagccg

SEQ ID NO: 58313 - DNA, 20 bp, Artificial Sequence
  sgRNA
  Sorcs3_12
gtacactgctctccatctcg

SEQ ID NO: 58314 - DNA, 20 bp, Artificial Sequence
  sgRNA
  Sorcs3_13
agtcctccttggtacagcgc

SEQ ID NO: 58315 - DNA, 20 bp, Artificial Sequence
  sgRNA
  Sorcs3_14
aacgccccatccacgaaaag

SEQ ID NO: 58316 - DNA, 20 bp, Artificial Sequence
  sgRNA
  Sorcs3_15
ggttgacatagagataactg

SEQ ID NO: 58317 - DNA, 20 bp, Artificial Sequence
  sgRNA
  Sorcs3_16
tattccgtattgcgacgaat

SEQ ID NO: 58318 - DNA, 20 bp, Artificial Sequence
  sgRNA
  Sorcs3_17
gggcatagatgttaatccag

SEQ ID NO: 58319 - DNA, 20 bp, Artificial Sequence
  sgRNA
  Sorcs3_18
ggaagccgtcctcacaccaa

SEQ ID NO: 58320 - DNA, 20 bp, Artificial Sequence
  sgRNA
  Sorcs3_19
gggcgacctaccaaaagtac

SEQ ID NO: 58321 - DNA, 20 bp, Artificial Sequence
  sgRNA
  Sorcs3_20
aaaccaccagaagtaggtga

SEQ ID NO: 58322 - DNA, 20 bp, Artificial Sequence
  sgRNA
  Sorl1_1
tcacgtcctctgacacaagg

SEQ ID NO: 58323 - DNA, 20 bp, Artificial Sequence
  sgRNA
  Sorl1_2
actgctagagatgtacacat

SEQ ID NO: 58324 - DNA, 20 bp, Artificial Sequence
  sgRNA
  Sorl1_3
cttctccatcccattccggg

SEQ ID NO: 58325 - DNA, 20 bp, Artificial Sequence
  sgRNA
  Sorl1_4
gcacccgggaggactacgaa

SEQ ID NO: 58326 - DNA, 20 bp, Artificial Sequence
  sgRNA
  Sorl1_5
gtttgccgactttcaccgcg

SEQ ID NO: 58327 - DNA, 20 bp, Artificial Sequence
  sgRNA
  Sorl1_6
gggtgttgatcccttaccaa

SEQ ID NO: 58328 - DNA, 20 bp, Artificial Sequence
  sgRNA
  Sorl1_7
aattgtccgtagtattcccg

SEQ ID NO: 58329 - DNA, 20 bp, Artificial Sequence
  sgRNA
  Sorl1_8
tctccggctaggaacgcacg

SEQ ID NO: 58330 - DNA, 20 bp, Artificial Sequence
  sgRNA
  Sorl1_9
gtgacagtgcactccctccg

SEQ ID NO: 58331 - DNA, 20 bp, Artificial Sequence
  sgRNA
  Sorl1_10
ctaccgctacgacttggcct

SEQ ID NO: 58332 - DNA, 20 bp, Artificial Sequence
  sgRNA
  Sorl1_11
ttacatcgctgatgccgccg

SEQ ID NO: 58333 - DNA, 20 bp, Artificial Sequence
  sgRNA
  Sorl1_12
cctgggtcgatcaagcacag

SEQ ID NO: 58334 - DNA, 20 bp, Artificial Sequence
  sgRNA
  Sorl1_13
gtattggtctgacctggcgc

SEQ ID NO: 58335 - DNA, 20 bp, Artificial Sequence
  sgRNA
  Sorl1_14
ggcttgctagaatctccacc

SEQ ID NO: 58336 - DNA, 20 bp, Artificial Sequence
  sgRNA
  Sorl1_15
ggtgacactcgaactcaaat

SEQ ID NO: 58337 - DNA, 20 bp, Artificial Sequence
  sgRNA
  Sorl1_16
ggtagcaatgatgagaccgg

SEQ ID NO: 58338 - DNA, 20 bp, Artificial Sequence
  sgRNA
  Sorl1_17
gtttcggtagaggtcaagga

SEQ ID NO: 58339 - DNA, 20 bp, Artificial Sequence
  sgRNA
  Sorl1_18
ttcctagccggagatcgcgc

SEQ ID NO: 58340 - DNA, 20 bp, Artificial Sequence
  sgRNA
  Sorl1_19
ctctgtgcttgatcgaccca

SEQ ID NO: 58341 - DNA, 20 bp, Artificial Sequence
  sgRNA
  Sorl1_20
acactttcacggtccaagcg

SEQ ID NO: 58342 - DNA, 20 bp, Artificial Sequence
  sgRNA
  Sort1_1
ttgttatatagaccccacgg

SEQ ID NO: 58343 - DNA, 20 bp, Artificial Sequence
  sgRNA
  Sort1_2
gctgaccaacaatacgcacc

SEQ ID NO: 58344 - DNA, 20 bp, Artificial Sequence
  sgRNA
  Sort1_3
taccgcaaagaacaagaacg

SEQ ID NO: 58345 - DNA, 20 bp, Artificial Sequence
  sgRNA
  Sort1_4
tgggcaggtgatactaacag

SEQ ID NO: 58346 - DNA, 20 bp, Artificial Sequence
  sgRNA
  Sort1_5
ctaacagcggaggtgtccgg

SEQ ID NO: 58347 - DNA, 20 bp, Artificial Sequence
  sgRNA
  Sort1_6
tgttatatagaccccacgga

SEQ ID NO: 58348 - DNA, 20 bp, Artificial Sequence
  sgRNA
  Sort1_7
gcttggcgatgaagtccggg

SEQ ID NO: 58349 - DNA, 20 bp, Artificial Sequence
  sgRNA
  Sort1_8
aagaggatgactataccacg

SEQ ID NO: 58350 - DNA, 20 bp, Artificial Sequence
  sgRNA
  Sort1_9
ggatgttctccataattcca

SEQ ID NO: 58351 - DNA, 20 bp, Artificial Sequence
  sgRNA
  Sort1_10
gttctgtctgtacggcaagg

SEQ ID NO: 58352 - DNA, 20 bp, Artificial Sequence
  sgRNA
  Sort1_11
aggagcacctgacaacaaat

SEQ ID NO: 58353 - DNA, 20 bp, Artificial Sequence
  sgRNA
  Sort1_12
gccgcagtcttggtcctcgg

SEQ ID NO: 58354 - DNA, 20 bp, Artificial Sequence
  sgRNA
  Sort1_13
ggaaaaaccttcaaaaccat

SEQ ID NO: 58355 - DNA, 20 bp, Artificial Sequence
  sgRNA
  Sort1_14
gtctcgaccattctgacaga

SEQ ID NO: 58356 - DNA, 20 bp, Artificial Sequence
  sgRNA
  Sort1_15
gtgtacatctcagatgatgg

SEQ ID NO: 58357 - DNA, 20 bp, Artificial Sequence
  sgRNA
  Sort1_16
gctgctgtagcaccgagtac

SEQ ID NO: 58358 - DNA, 20 bp, Artificial Sequence
  sgRNA
  Sort1_17
tgactttggctacttccgtc

SEQ ID NO: 58359 - DNA, 20 bp, Artificial Sequence
  sgRNA
  Sort1_18
ggagaacgcctcagagtgcg

SEQ ID NO: 58360 - DNA, 20 bp, Artificial Sequence
  sgRNA
  Sort1_19
acaggtaatcagaattctga

SEQ ID NO: 58361 - DNA, 20 bp, Artificial Sequence
  sgRNA
  Sort1_20
acttaatcacattgatagga

SEQ ID NO: 58362 - DNA, 20 bp, Artificial Sequence
  sgRNA
  Spaca1_1
ggtgacattcgatgcctgcg

SEQ ID NO: 58363 - DNA, 20 bp, Artificial Sequence
  sgRNA
  Spaca1_2
cgagtccgaaaccacagccg

SEQ ID NO: 58364 - DNA, 20 bp, Artificial Sequence
  sgRNA
  Spaca1_3
ggaatgtgcacagtcacgtg

SEQ ID NO: 58365 - DNA, 20 bp, Artificial Sequence
  sgRNA
  Spaca1_4
tgccgtggacctgttgattg

SEQ ID NO: 58366 - DNA, 20 bp, Artificial Sequence
  sgRNA
  Spaca1_5
gtgtcacattcaaaagccag

SEQ ID NO: 58367 - DNA, 20 bp, Artificial Sequence
  sgRNA
  Spaca1_6
tcgaatgtcacctccagcgg

SEQ ID NO: 58368 - DNA, 20 bp, Artificial Sequence
  sgRNA
  Spaca1_7
gcatcgaatgtcacctccag

SEQ ID NO: 58369 - DNA, 20 bp, Artificial Sequence
  sgRNA
  Spaca1_8
aatgtcacctccagcggcgg

SEQ ID NO: 58370 - DNA, 20 bp, Artificial Sequence
  sgRNA
  Spaca1_9
cacagccgaggccgatgccg

SEQ ID NO: 58371 - DNA, 20 bp, Artificial Sequence
  sgRNA
  Spaca1_10
caccaggatcagccatccga

SEQ ID NO: 58372 - DNA, 20 bp, Artificial Sequence
  sgRNA
  Spaca1_11
atagtcaaagaagtagaatt

SEQ ID NO: 58373 - DNA, 20 bp, Artificial Sequence
  sgRNA
  Spaca1_12
gttcgtgtggaagaatgccg

SEQ ID NO: 58374 - DNA, 20 bp, Artificial Sequence
  sgRNA
  Spaca1_13
agtccgagctgagctctatg

SEQ ID NO: 58375 - DNA, 20 bp, Artificial Sequence
  sgRNA
  Spaca1_14
cggcagtgaaatccttctgg

SEQ ID NO: 58376 - DNA, 20 bp, Artificial Sequence
  sgRNA
  Spaca1_15
atacctcatagagctcagct

SEQ ID NO: 58377 - DNA, 20 bp, Artificial Sequence
  sgRNA
  Spaca1_16
ctgggctgctggccgtcgga

SEQ ID NO: 58378 - DNA, 20 bp, Artificial Sequence
  sgRNA
  Spaca1_17
ttaaccaatggatgccctgg

SEQ ID NO: 58379 - DNA, 20 bp, Artificial Sequence
  sgRNA
  Spaca1_18
cgaggccgatgccgaggaag

SEQ ID NO: 58380 - DNA, 20 bp, Artificial Sequence
  sgRNA
  Spaca1_19
ctcttcctcggcatcggcct

SEQ ID NO: 58381 - DNA, 20 bp, Artificial Sequence
  sgRNA
  Spaca1_20
gcggcagtgaaatccttctg

SEQ ID NO: 58382 - DNA, 20 bp, Artificial Sequence
  sgRNA
  Spaca4_1
tggcacacacatgcgctgtg

SEQ ID NO: 58383 - DNA, 20 bp, Artificial Sequence
  sgRNA
  Spaca4_2
gtggggcccatcatcaacaa

SEQ ID NO: 58384 - DNA, 20 bp, Artificial Sequence
  sgRNA
  Spaca4_3
ccttgatgcctgtcacacct

SEQ ID NO: 58385 - DNA, 20 bp, Artificial Sequence
  sgRNA
  Spaca4_4
gaagattgcttcacaggcca

SEQ ID NO: 58386 - DNA, 20 bp, Artificial Sequence
  sgRNA
  Spaca4_5
ccacaccctgggctactccg

SEQ ID NO: 58387 - DNA, 20 bp, Artificial Sequence
  sgRNA
  Spaca4_6
tgtagctgatgggttcctcg

SEQ ID NO: 58388 - DNA, 20 bp, Artificial Sequence
  sgRNA
  Spaca4_7
gtgagctgactgactctgct

SEQ ID NO: 58389 - DNA, 20 bp, Artificial Sequence
  sgRNA
  Spaca4_8
gcagctgcagacccagtgac

SEQ ID NO: 58390 - DNA, 20 bp, Artificial Sequence
  sgRNA
  Spaca4_9
acaggccacggagtagccca

SEQ ID NO: 58391 - DNA, 20 bp, Artificial Sequence
  sgRNA
  Spaca4_10
agggcactggcctttccaca

SEQ ID NO: 58392 - DNA, 20 bp, Artificial Sequence
  sgRNA
  Spaca4_11
agaaccaacaccagaagcag

SEQ ID NO: 58393 - DNA, 20 bp, Artificial Sequence
  sgRNA
  Spaca4_12
ggggctaccagcctgtcact

SEQ ID NO: 58394 - DNA, 20 bp, Artificial Sequence
  sgRNA
  Spaca4_13
gtgaggcccatgtagctgat

SEQ ID NO: 58395 - DNA, 20 bp, Artificial Sequence
  sgRNA
  Spaca4_14
cgaggaacccatcagctaca

SEQ ID NO: 58396 - DNA, 20 bp, Artificial Sequence
  sgRNA
  Spaca4_15
gttctttgcccaggtgtgac

SEQ ID NO: 58397 - DNA, 20 bp, Artificial Sequence
  sgRNA
  Spaca4_16
acgcagcctttgttgatgat

SEQ ID NO: 58398 - DNA, 20 bp, Artificial Sequence
  sgRNA
  Spaca4_17
ctccaccagctgtggccgcg

SEQ ID NO: 58399 - DNA, 20 bp, Artificial Sequence
  sgRNA
  Spaca4_18
tggtggtgagactgtatgtg

SEQ ID NO: 58400 - DNA, 20 bp, Artificial Sequence
  sgRNA
  Spaca4_19
cacaggccacggagtagccc

SEQ ID NO: 58401 - DNA, 20 bp, Artificial Sequence
  sgRNA
  Spaca4_20
ggccagtgcccttattgcaa

SEQ ID NO: 58402 - DNA, 20 bp, Artificial Sequence
  sgRNA
  Spam1_1
gtcccaactgaacgttgtgt

SEQ ID NO: 58403 - DNA, 20 bp, Artificial Sequence
  sgRNA
  Spam1_2
aactcggtagcggacataga

SEQ ID NO: 58404 - DNA, 20 bp, Artificial Sequence
  sgRNA
  Spam1_3
gcttgataatcgcccctctg

SEQ ID NO: 58405 - DNA, 20 bp, Artificial Sequence
  sgRNA
  Spam1_4
tacctctgaataccttctag

SEQ ID NO: 58406 - DNA, 20 bp, Artificial Sequence
  sgRNA
  Spam1_5
ctatgtccgctaccgagttg

SEQ ID NO: 58407 - DNA, 20 bp, Artificial Sequence
  sgRNA
  Spam1_6
tatgagtttagcacaacgtg

SEQ ID NO: 58408 - DNA, 20 bp, Artificial Sequence
  sgRNA
  Spam1_7
ggaaacctaaggataactac

SEQ ID NO: 58409 - DNA, 20 bp, Artificial Sequence
  sgRNA
  Spam1_8
tagcttccacaactcggtag

SEQ ID NO: 58410 - DNA, 20 bp, Artificial Sequence
  sgRNA
  Spam1_9
attctaagtctccaaccctg

SEQ ID NO: 58411 - DNA, 20 bp, Artificial Sequence
  sgRNA
  Spam1_10
gtactgactagtgtcttccg

SEQ ID NO: 58412 - DNA, 20 bp, Artificial Sequence
  sgRNA
  Spam1_11
gcccccggaaaactgccaca

SEQ ID NO: 58413 - DNA, 20 bp, Artificial Sequence
  sgRNA
  Spam1_12
gtccaaggttgggaatgcat

SEQ ID NO: 58414 - DNA, 20 bp, Artificial Sequence
  sgRNA
  Spam1_13
gattccatgctccttgactg

SEQ ID NO: 58415 - DNA, 20 bp, Artificial Sequence
  sgRNA
  Spam1_14
cttcgaccaaaccagctatg

SEQ ID NO: 58416 - DNA, 20 bp, Artificial Sequence
  sgRNA
  Spam1_15
gctaagcccaatttgtcgtc

SEQ ID NO: 58417 - DNA, 20 bp, Artificial Sequence
  sgRNA
  Spam1_16
aaccaagcagaacattatgg

SEQ ID NO: 58418 - DNA, 20 bp, Artificial Sequence
  sgRNA
  Spam1_17
ctctgatagcttccacaact

SEQ ID NO: 58419 - DNA, 20 bp, Artificial Sequence
  sgRNA
  Spam1_18
caacaaagctcccccaaaag

SEQ ID NO: 58420 - DNA, 20 bp, Artificial Sequence
  sgRNA
  Spam1_19
tatggaggaatacctcagag

SEQ ID NO: 58421 - DNA, 20 bp, Artificial Sequence
  sgRNA
  Spam1_20
agacggatatagacaaaaat

SEQ ID NO: 58422 - DNA, 20 bp, Artificial Sequence
  sgRNA
  Spint2_1
agccgagaactagacgtcca

SEQ ID NO: 58423 - DNA, 20 bp, Artificial Sequence
  sgRNA
  Spint2_2
tcagtgtcatagtaccagcg

SEQ ID NO: 58424 - DNA, 20 bp, Artificial Sequence
  sgRNA
  Spint2_3
ggtggtacaatatcactgat

SEQ ID NO: 58425 - DNA, 20 bp, Artificial Sequence
  sgRNA
  Spint2_4
caataactaccagagcaagg

SEQ ID NO: 58426 - DNA, 20 bp, Artificial Sequence
  sgRNA
  Spint2_5
gcagcgaagctaccaaggcg

SEQ ID NO: 58427 - DNA, 20 bp, Artificial Sequence
  sgRNA
  Spint2_6
tatggtctgcctcatccgtg

SEQ ID NO: 58428 - DNA, 20 bp, Artificial Sequence
  sgRNA
  Spint2_7
tgtatcagcttcatctacgg

SEQ ID NO: 58429 - DNA, 20 bp, Artificial Sequence
  sgRNA
  Spint2_8
gtatcagcttcatctacggc

SEQ ID NO: 58430 - DNA, 20 bp, Artificial Sequence
  sgRNA
  Spint2_9
cagctttgtgagctgcggcg

SEQ ID NO: 58431 - DNA, 20 bp, Artificial Sequence
  sgRNA
  Spint2_10
gcgcactgtttggagcactg

SEQ ID NO: 58432 - DNA, 20 bp, Artificial Sequence
  sgRNA
  Spint2_11
cagtgtcatagtaccagcga

SEQ ID NO: 58433 - DNA, 20 bp, Artificial Sequence
  sgRNA
  Spint2_12
cctgctttctgcgaaccaca

SEQ ID NO: 58434 - DNA, 20 bp, Artificial Sequence
  sgRNA
  Spint2_13
gtgtcccgaaggccgtcact

SEQ ID NO: 58435 - DNA, 20 bp, Artificial Sequence
  sgRNA
  Spint2_14
gatgcatcctttcctgaccc

SEQ ID NO: 58436 - DNA, 20 bp, Artificial Sequence
  sgRNA
  Spint2_15
agaccatagaggttcccagg

SEQ ID NO: 58437 - DNA, 20 bp, Artificial Sequence
  sgRNA
  Spint2_16
agttgaagatctcagcagac

SEQ ID NO: 58438 - DNA, 20 bp, Artificial Sequence
  sgRNA
  Spint2_17
ggaggaggatcagaaccatg

SEQ ID NO: 58439 - DNA, 20 bp, Artificial Sequence
  sgRNA
  Spint2_18
gtagcttcgctgctcctctc

SEQ ID NO: 58440 - DNA, 20 bp, Artificial Sequence
  sgRNA
  Spint2_19
gtgatattgtaccaccacct

SEQ ID NO: 58441 - DNA, 20 bp, Artificial Sequence
  sgRNA
  Spint2_20
tgccagccatttgtttatgg

SEQ ID NO: 58442 - DNA, 20 bp, Artificial Sequence
  sgRNA
  Spn_1
acaagctctaacgagaccag

SEQ ID NO: 58443 - DNA, 20 bp, Artificial Sequence
  sgRNA
  Spn_2
gcagccaatcctgtgacaga

SEQ ID NO: 58444 - DNA, 20 bp, Artificial Sequence
  sgRNA
  Spn_3
gggatcttgggtagacgtcg

SEQ ID NO: 58445 - DNA, 20 bp, Artificial Sequence
  sgRNA
  Spn_4
cgagcccagacagtctgcag

SEQ ID NO: 58446 - DNA, 20 bp, Artificial Sequence
  sgRNA
  Spn_5
ctgaccccacagaaactgat

SEQ ID NO: 58447 - DNA, 20 bp, Artificial Sequence
  sgRNA
  Spn_6
agtccatgcatctcactcga

SEQ ID NO: 58448 - DNA, 20 bp, Artificial Sequence
  sgRNA
  Spn_7
gtggaaaccccaacttctga

SEQ ID NO: 58449 - DNA, 20 bp, Artificial Sequence
  sgRNA
  Spn_8
ggcgccagaggcaaaagcgg

SEQ ID NO: 58450 - DNA, 20 bp, Artificial Sequence
  sgRNA
  Spn_9
ctgaagaacgtagtgagcgt

SEQ ID NO: 58451 - DNA, 20 bp, Artificial Sequence
  sgRNA
  Spn_10
tcactacgttcttcagcaga

SEQ ID NO: 58452 - DNA, 20 bp, Artificial Sequence
  sgRNA
  Spn_11
aggagaccatcagcccctgg

SEQ ID NO: 58453 - DNA, 20 bp, Artificial Sequence
  sgRNA
  Spn_12
gctgaagaacgtagtgagcg

SEQ ID NO: 58454 - DNA, 20 bp, Artificial Sequence
  sgRNA
  Spn_13
agaggccacaaccacatcag

SEQ ID NO: 58455 - DNA, 20 bp, Artificial Sequence
  sgRNA
  Spn_14
acaattcagtagtttccaag

SEQ ID NO: 58456 - DNA, 20 bp, Artificial Sequence
  sgRNA
  Spn_15
gctgtgatatgtggggtaga

SEQ ID NO: 58457 - DNA, 20 bp, Artificial Sequence
  sgRNA
  Spn_16
tcatcctcactgcccacaag

SEQ ID NO: 58458 - DNA, 20 bp, Artificial Sequence
  sgRNA
  Spn_17
acaacagcagtagcgccacg

SEQ ID NO: 58459 - DNA, 20 bp, Artificial Sequence
  sgRNA
  Spn_18
caacagcagtagcgccacga

SEQ ID NO: 58460 - DNA, 20 bp, Artificial Sequence
  sgRNA
  Spn_19
acttggagctgtgatatgtg

SEQ ID NO: 58461 - DNA, 20 bp, Artificial Sequence
  sgRNA
  Spn_20
tcaccaagccaagaatcaag

SEQ ID NO: 58462 - DNA, 20 bp, Artificial Sequence
  sgRNA
  Spns2_1
gggaggagaagacgtaactg

SEQ ID NO: 58463 - DNA, 20 bp, Artificial Sequence
  sgRNA
  Spns2_2
ttggtcccagccactaagag

SEQ ID NO: 58464 - DNA, 20 bp, Artificial Sequence
  sgRNA
  Spns2_3
ccgcgcccgtgactacgccc

SEQ ID NO: 58465 - DNA, 20 bp, Artificial Sequence
  sgRNA
  Spns2_4
tgagcacggtgaagatagag

SEQ ID NO: 58466 - DNA, 20 bp, Artificial Sequence
  sgRNA
  Spns2_5
agtcgtgtccgccgacgaag

SEQ ID NO: 58467 - DNA, 20 bp, Artificial Sequence
  sgRNA
  Spns2_6
gctcaggaactcccagagcg

SEQ ID NO: 58468 - DNA, 20 bp, Artificial Sequence
  sgRNA
  Spns2_7
aaaccggccagcttaggccg

SEQ ID NO: 58469 - DNA, 20 bp, Artificial Sequence
  sgRNA
  Spns2_8
cacgttgcctaaactcagga

SEQ ID NO: 58470 - DNA, 20 bp, Artificial Sequence
  sgRNA
  Spns2_9
tgagcacgttgcctaaactc

SEQ ID NO: 58471 - DNA, 20 bp, Artificial Sequence
  sgRNA
  Spns2_10
ttctattgaagcggtcgccc

SEQ ID NO: 58472 - DNA, 20 bp, Artificial Sequence
  sgRNA
  Spns2_11
ggccatgctgatcaacttgg

SEQ ID NO: 58473 - DNA, 20 bp, Artificial Sequence
  sgRNA
  Spns2_12
ggctactagtcctgtcccga

SEQ ID NO: 58474 - DNA, 20 bp, Artificial Sequence
  sgRNA
  Spns2_13
gggcgaccgcttcaatagaa

SEQ ID NO: 58475 - DNA, 20 bp, Artificial Sequence
  sgRNA
  Spns2_14
gggatgctggggagtccgga

SEQ ID NO: 58476 - DNA, 20 bp, Artificial Sequence
  sgRNA
  Spns2_15
ggatcacctttctattgaag

SEQ ID NO: 58477 - DNA, 20 bp, Artificial Sequence
  sgRNA
  Spns2_16
cctaatccgccagagcacca

SEQ ID NO: 58478 - DNA, 20 bp, Artificial Sequence
  sgRNA
  Spns2_17
tggaacctgtgatatagccc

SEQ ID NO: 58479 - DNA, 20 bp, Artificial Sequence
  sgRNA
  Spns2_18
ctgtgatcatgcccaggacg

SEQ ID NO: 58480 - DNA, 20 bp, Artificial Sequence
  sgRNA
  Spns2_19
cagcacgttgagtccgcagg

SEQ ID NO: 58481 - DNA, 20 bp, Artificial Sequence
  sgRNA
  Spns2_20
ccgcaggcggcaccaacgag

SEQ ID NO: 58482 - DNA, 20 bp, Artificial Sequence
  sgRNA
  Spns3_1
ctggttccagacgtaccccg

SEQ ID NO: 58483 - DNA, 20 bp, Artificial Sequence
  sgRNA
  Spns3_2
gccaagtaagctctccagcg

SEQ ID NO: 58484 - DNA, 20 bp, Artificial Sequence
  sgRNA
  Spns3_3
tgcggttgtatcggtcaccc

SEQ ID NO: 58485 - DNA, 20 bp, Artificial Sequence
  sgRNA
  Spns3_4
gtttctgtttgaagctcgcg

SEQ ID NO: 58486 - DNA, 20 bp, Artificial Sequence
  sgRNA
  Spns3_5
ctatggcgaaggcacaacac

SEQ ID NO: 58487 - DNA, 20 bp, Artificial Sequence
  sgRNA
  Spns3_6
gcaggaacaccgagagccaa

SEQ ID NO: 58488 - DNA, 20 bp, Artificial Sequence
  sgRNA
  Spns3_7
agacagaaggagctccccga

SEQ ID NO: 58489 - DNA, 20 bp, Artificial Sequence
  sgRNA
  Spns3_8
aagacagaaggagctccccg

SEQ ID NO: 58490 - DNA, 20 bp, Artificial Sequence
  sgRNA
  Spns3_9
tgtttctcagctgctcctcg

SEQ ID NO: 58491 - DNA, 20 bp, Artificial Sequence
  sgRNA
  Spns3_10
tggctcttcttcctgtcccg

SEQ ID NO: 58492 - DNA, 20 bp, Artificial Sequence
  sgRNA
  Spns3_11
gtatggctttgcggttgtat

SEQ ID NO: 58493 - DNA, 20 bp, Artificial Sequence
  sgRNA
  Spns3_12
acctcttcgtgaaggaccag

SEQ ID NO: 58494 - DNA, 20 bp, Artificial Sequence
  sgRNA
  Spns3_13
ggaggccaggagggtccgtg

SEQ ID NO: 58495 - DNA, 20 bp, Artificial Sequence
  sgRNA
  Spns3_14
gtacaagaaggtgaacccca

SEQ ID NO: 58496 - DNA, 20 bp, Artificial Sequence
  sgRNA
  Spns3_15
gagtgtctcaaacctcagac

SEQ ID NO: 58497 - DNA, 20 bp, Artificial Sequence
  sgRNA
  Spns3_16
gtctcaaacctcagacagga

SEQ ID NO: 58498 - DNA, 20 bp, Artificial Sequence
  sgRNA
  Spns3_17
gctgaggaagtgctgcaggt

SEQ ID NO: 58499 - DNA, 20 bp, Artificial Sequence
  sgRNA
  Spns3_18
cgaggagcagctgagaaaca

SEQ ID NO: 58500 - DNA, 20 bp, Artificial Sequence
  sgRNA
  Spns3_19
gccagagcctgagccaaggt

SEQ ID NO: 58501 - DNA, 20 bp, Artificial Sequence
  sgRNA
  Spns3_20
agtcttcatcagctgcctgc

SEQ ID NO: 58502 - DNA, 20 bp, Artificial Sequence
  sgRNA
  Sppl2a_1
ttgattcataggatgccatg

SEQ ID NO: 58503 - DNA, 20 bp, Artificial Sequence
  sgRNA
  Sppl2a_2
tgtaattgctgtgttcactg

SEQ ID NO: 58504 - DNA, 20 bp, Artificial Sequence
  sgRNA
  Sppl2a_3
tggcataaggaacaaggcag

SEQ ID NO: 58505 - DNA, 20 bp, Artificial Sequence
  sgRNA
  Sppl2a_4
gtgggctgtatttcgaaatg

SEQ ID NO: 58506 - DNA, 20 bp, Artificial Sequence
  sgRNA
  Sppl2a_5
ctgtatttcgaaatgaggat

SEQ ID NO: 58507 - DNA, 20 bp, Artificial Sequence
  sgRNA
  Sppl2a_6
gccttgttccttatgccatc

SEQ ID NO: 58508 - DNA, 20 bp, Artificial Sequence
  sgRNA
  Sppl2a_7
agtatagtcaaagttaggcc

SEQ ID NO: 58509 - DNA, 20 bp, Artificial Sequence
  sgRNA
  Sppl2a_8
tgaaaaagccagaattgcac

SEQ ID NO: 58510 - DNA, 20 bp, Artificial Sequence
  sgRNA
  Sppl2a_9
gagacagtaataagtgtaca

SEQ ID NO: 58511 - DNA, 20 bp, Artificial Sequence
  sgRNA
  Sppl2a_10
gtagatttgttccttgagga

SEQ ID NO: 58512 - DNA, 20 bp, Artificial Sequence
  sgRNA
  Sppl2a_11
agaagattcgatgttcagac

SEQ ID NO: 58513 - DNA, 20 bp, Artificial Sequence
  sgRNA
  Sppl2a_12
acgaacacaacaaccgtgag

SEQ ID NO: 58514 - DNA, 20 bp, Artificial Sequence
  sgRNA
  Sppl2a_13
agtcgttgcttggagtcgta

SEQ ID NO: 58515 - DNA, 20 bp, Artificial Sequence
  sgRNA
  Sppl2a_14
ttactgtctcagtcgttgct

SEQ ID NO: 58516 - DNA, 20 bp, Artificial Sequence
  sgRNA
  Sppl2a_15
ttgttccttatgccatcagg

SEQ ID NO: 58517 - DNA, 20 bp, Artificial Sequence
  sgRNA
  Sppl2a_16
atttgtagacgcatgcagaa

SEQ ID NO: 58518 - DNA, 20 bp, Artificial Sequence
  sgRNA
  Sppl2a_17
gcagcctgctctcctctact

SEQ ID NO: 58519 - DNA, 20 bp, Artificial Sequence
  sgRNA
  Sppl2a_18
atattcctcctgatggcata

SEQ ID NO: 58520 - DNA, 20 bp, Artificial Sequence
  sgRNA
  Sppl2a_19
tttggcaccctgataactac

SEQ ID NO: 58521 - DNA, 20 bp, Artificial Sequence
  sgRNA
  Sppl2a_20
catcaccatcaggacaacaa

SEQ ID NO: 58522 - DNA, 20 bp, Artificial Sequence
  sgRNA
  Sppl2b_1
gccagtgatggactacaaca

SEQ ID NO: 58523 - DNA, 20 bp, Artificial Sequence
  sgRNA
  Sppl2b_2
tccaatgatcacgtagactg

SEQ ID NO: 58524 - DNA, 20 bp, Artificial Sequence
  sgRNA
  Sppl2b_3
cttcaccaaccaaatcgcac

SEQ ID NO: 58525 - DNA, 20 bp, Artificial Sequence
  sgRNA
  Sppl2b_4
catcacccccttcctgacca

SEQ ID NO: 58526 - DNA, 20 bp, Artificial Sequence
  sgRNA
  Sppl2b_5
ggttggtgaagtcttctgca

SEQ ID NO: 58527 - DNA, 20 bp, Artificial Sequence
  sgRNA
  Sppl2b_6
gagtggtgtcccaaaccagt

SEQ ID NO: 58528 - DNA, 20 bp, Artificial Sequence
  sgRNA
  Sppl2b_7
acagtgccaccattacctca

SEQ ID NO: 58529 - DNA, 20 bp, Artificial Sequence
  sgRNA
  Sppl2b_8
catcctctacaacccacagt

SEQ ID NO: 58530 - DNA, 20 bp, Artificial Sequence
  sgRNA
  Sppl2b_9
ctactacttctatgaccgcc

SEQ ID NO: 58531 - DNA, 20 bp, Artificial Sequence
  sgRNA
  Sppl2b_10
tgtggctcagcagggccaca

SEQ ID NO: 58532 - DNA, 20 bp, Artificial Sequence
  sgRNA
  Sppl2b_11
tcatgggtggatgagttcga

SEQ ID NO: 58533 - DNA, 20 bp, Artificial Sequence
  sgRNA
  Sppl2b_12
aagtctctggcttcaccaca

SEQ ID NO: 58534 - DNA, 20 bp, Artificial Sequence
  sgRNA
  Sppl2b_13
gctcttgtcctcatgcagcg

SEQ ID NO: 58535 - DNA, 20 bp, Artificial Sequence
  sgRNA
  Sppl2b_14
tgaggctcagcctatccctg

SEQ ID NO: 58536 - DNA, 20 bp, Artificial Sequence
  sgRNA
  Sppl2b_15
acagctgtagagaccggtgg

SEQ ID NO: 58537 - DNA, 20 bp, Artificial Sequence
  sgRNA
  Sppl2b_16
gagccacgaaggtcaccagg

SEQ ID NO: 58538 - DNA, 20 bp, Artificial Sequence
  sgRNA
  Sppl2b_17
ggttgtcaggatccttggca

SEQ ID NO: 58539 - DNA, 20 bp, Artificial Sequence
  sgRNA
  Sppl2b_18
cttctatgagaaagtgcggc

SEQ ID NO: 58540 - DNA, 20 bp, Artificial Sequence
  sgRNA
  Sppl2b_19
cagacagctgtagagaccgg

SEQ ID NO: 58541 - DNA, 20 bp, Artificial Sequence
  sgRNA
  Sppl2b_20
agatgtctccaaagcccagg

SEQ ID NO: 58542 - DNA, 20 bp, Artificial Sequence
  sgRNA
  Sppl2c_1
ctggttgcacaacgtcaagg

SEQ ID NO: 58543 - DNA, 20 bp, Artificial Sequence
  sgRNA
  Sppl2c_2
actactaccatggtcacgcg

SEQ ID NO: 58544 - DNA, 20 bp, Artificial Sequence
  sgRNA
  Sppl2c_3
aaagtgcagttcttgaacgt

SEQ ID NO: 58545 - DNA, 20 bp, Artificial Sequence
  sgRNA
  Sppl2c_4
tatagtcagtaacaggctcg

SEQ ID NO: 58546 - DNA, 20 bp, Artificial Sequence
  sgRNA
  Sppl2c_5
aggattcccgtacaaccaac

SEQ ID NO: 58547 - DNA, 20 bp, Artificial Sequence
  sgRNA
  Sppl2c_6
tgactacgtcaacctccccc

SEQ ID NO: 58548 - DNA, 20 bp, Artificial Sequence
  sgRNA
  Sppl2c_7
gatgaagccacgagtccaga

SEQ ID NO: 58549 - DNA, 20 bp, Artificial Sequence
  sgRNA
  Sppl2c_8
gcccctatggcgataccagt

SEQ ID NO: 58550 - DNA, 20 bp, Artificial Sequence
  sgRNA
  Sppl2c_9
cccacagcagaggcaatgca

SEQ ID NO: 58551 - DNA, 20 bp, Artificial Sequence
  sgRNA
  Sppl2c_10
ctactatatggcctgtacag

SEQ ID NO: 58552 - DNA, 20 bp, Artificial Sequence
  sgRNA
  Sppl2c_11
acagttgccacgcgtgacca

SEQ ID NO: 58553 - DNA, 20 bp, Artificial Sequence
  sgRNA
  Sppl2c_12
cctgcaccagactactacca

SEQ ID NO: 58554 - DNA, 20 bp, Artificial Sequence
  sgRNA
  Sppl2c_13
aagccacgagaggttaccaa

SEQ ID NO: 58555 - DNA, 20 bp, Artificial Sequence
  sgRNA
  Sppl2c_14
catggacccgagattgagtg

SEQ ID NO: 58556 - DNA, 20 bp, Artificial Sequence
  sgRNA
  Sppl2c_15
tagtcagtaacaggctcgag

SEQ ID NO: 58557 - DNA, 20 bp, Artificial Sequence
  sgRNA
  Sppl2c_16
gctcacaatgagcaacccct

SEQ ID NO: 58558 - DNA, 20 bp, Artificial Sequence
  sgRNA
  Sppl2c_17
gtacccgcctcaggacaaaa

SEQ ID NO: 58559 - DNA, 20 bp, Artificial Sequence
  sgRNA
  Sppl2c_18
ctcaagatcaaggcgcccag

SEQ ID NO: 58560 - DNA, 20 bp, Artificial Sequence
  sgRNA
  Sppl2c_19
gccctggccagtccagaaaa

SEQ ID NO: 58561 - DNA, 20 bp, Artificial Sequence
  sgRNA
  Sppl2c_20
gctggacactaagtagagca

SEQ ID NO: 58562 - DNA, 20 bp, Artificial Sequence
  sgRNA
  Sprn_1
gggcatcaagagtacgcgta

SEQ ID NO: 58563 - DNA, 20 bp, Artificial Sequence
  sgRNA
  Sprn_2
cggctcctctctgcgcgtgg

SEQ ID NO: 58564 - DNA, 20 bp, Artificial Sequence
  sgRNA
  Sprn_3
gacagctgttccgccaaggg

SEQ ID NO: 58565 - DNA, 20 bp, Artificial Sequence
  sgRNA
  Sprn_4
gcgctcgaggcagtgcccgg

SEQ ID NO: 58566 - DNA, 20 bp, Artificial Sequence
  sgRNA
  Sprn_5
ggaggcaacggaaccgaccg

SEQ ID NO: 58567 - DNA, 20 bp, Artificial Sequence
  sgRNA
  Sprn_6
ctacggctcctctctgcgcg

SEQ ID NO: 58568 - DNA, 20 bp, Artificial Sequence
  sgRNA
  Sprn_7
aagcagttctagggcaccaa

SEQ ID NO: 58569 - DNA, 20 bp, Artificial Sequence
  sgRNA
  Sprn_8
gtagctgtagactcctcggt

SEQ ID NO: 58570 - DNA, 20 bp, Artificial Sequence
  sgRNA
  Sprn_9
cgcagagaggagccgtagcg

SEQ ID NO: 58571 - DNA, 20 bp, Artificial Sequence
  sgRNA
  Sprn_10
cgtatttgtctgcttctggg

SEQ ID NO: 58572 - DNA, 20 bp, Artificial Sequence
  sgRNA
  Sprn_11
acaaatacgtgggctgtgca

SEQ ID NO: 58573 - DNA, 20 bp, Artificial Sequence
  sgRNA
  Sprn_12
gctgtcacagaggaaggcgg

SEQ ID NO: 58574 - DNA, 20 bp, Artificial Sequence
  sgRNA
  Sprn_13
ccgaggagtctacagctact

SEQ ID NO: 58575 - DNA, 20 bp, Artificial Sequence
  sgRNA
  Sprn_14
gcctagctctccaggccctg

SEQ ID NO: 58576 - DNA, 20 bp, Artificial Sequence
  sgRNA
  Sprn_15
ccagaagcagacaaatacgt

SEQ ID NO: 58577 - DNA, 20 bp, Artificial Sequence
  sgRNA
  Sprn_16
gatgagaatggggcaatggg

SEQ ID NO: 58578 - DNA, 20 bp, Artificial Sequence
  sgRNA
  Sprn_17
atcaagagtacgcgtaaggc

SEQ ID NO: 58579 - DNA, 20 bp, Artificial Sequence
  sgRNA
  Sprn_18
ggtcctcctccagccagagc

SEQ ID NO: 58580 - DNA, 20 bp, Artificial Sequence
  sgRNA
  Sprn_19
tggcggaacagctgtcacag

SEQ ID NO: 58581 - DNA, 20 bp, Artificial Sequence
  sgRNA
  Sprn_20
gctgtgcacggaccctgagc

SEQ ID NO: 58582 - DNA, 20 bp, Artificial Sequence
  sgRNA
  Sspn_1
agtatctctgactagcaggg

SEQ ID NO: 58583 - DNA, 20 bp, Artificial Sequence
  sgRNA
  Sspn_2
cttgcactggcaagaatcca

SEQ ID NO: 58584 - DNA, 20 bp, Artificial Sequence
  sgRNA
  Sspn_3
actgcgcaagcagggagtag

SEQ ID NO: 58585 - DNA, 20 bp, Artificial Sequence
  sgRNA
  Sspn_4
tcaggccgagggcactcaac

SEQ ID NO: 58586 - DNA, 20 bp, Artificial Sequence
  sgRNA
  Sspn_5
gcaggtaaactgcgcaagca

SEQ ID NO: 58587 - DNA, 20 bp, Artificial Sequence
  sgRNA
  Sspn_6
tctcataccaagttgacgag

SEQ ID NO: 58588 - DNA, 20 bp, Artificial Sequence
  sgRNA
  Sspn_7
gcatgcagaccatcaggccg

SEQ ID NO: 58589 - DNA, 20 bp, Artificial Sequence
  sgRNA
  Sspn_8
gcagctggcgttgggcatcg

SEQ ID NO: 58590 - DNA, 20 bp, Artificial Sequence
  sgRNA
  Sspn_9
gcgcaagcagggagtagtgg

SEQ ID NO: 58591 - DNA, 20 bp, Artificial Sequence
  sgRNA
  Sspn_10
gcactggcaagaatccaggg

SEQ ID NO: 58592 - DNA, 20 bp, Artificial Sequence
  sgRNA
  Sspn_11
gctttgtgatgtggaaacac

SEQ ID NO: 58593 - DNA, 20 bp, Artificial Sequence
  sgRNA
  Sspn_12
gttgagtgccctcggcctga

SEQ ID NO: 58594 - DNA, 20 bp, Artificial Sequence
  sgRNA
  Sspn_13
taaacaaaggccctgctgag

SEQ ID NO: 58595 - DNA, 20 bp, Artificial Sequence
  sgRNA
  Sspn_14
catgcagaccatcaggccga

SEQ ID NO: 58596 - DNA, 20 bp, Artificial Sequence
  sgRNA
  Sspn_15
cggagtatctctgactagca

SEQ ID NO: 58597 - DNA, 20 bp, Artificial Sequence
  sgRNA
  Sspn_16
agaccaggtttaggaccatc

SEQ ID NO: 58598 - DNA, 20 bp, Artificial Sequence
  sgRNA
  Sspn_17
gcagcagtgccagcagcagc

SEQ ID NO: 58599 - DNA, 20 bp, Artificial Sequence
  sgRNA
  Sspn_18
tacttcctgttgagtgccct

SEQ ID NO: 58600 - DNA, 20 bp, Artificial Sequence
  sgRNA
  Sspn_19
acaatgatcccagcccagaa

SEQ ID NO: 58601 - DNA, 20 bp, Artificial Sequence
  sgRNA
  Sspn_20
agctgcctgaggaggaggcg

SEQ ID NO: 58602 - DNA, 20 bp, Artificial Sequence
  sgRNA
  Ssr1_1
gtcctgaggataacggaacg

SEQ ID NO: 58603 - DNA, 20 bp, Artificial Sequence
  sgRNA
  Ssr1_2
acactgtagtgccaccccag

SEQ ID NO: 58604 - DNA, 20 bp, Artificial Sequence
  sgRNA
  Ssr1_3
ccaaagggtcgtcctcccat

SEQ ID NO: 58605 - DNA, 20 bp, Artificial Sequence
  sgRNA
  Ssr1_4
gccgcctcggagcagcacgg

SEQ ID NO: 58606 - DNA, 20 bp, Artificial Sequence
  sgRNA
  Ssr1_5
agattgataaccagaccaaa

SEQ ID NO: 58607 - DNA, 20 bp, Artificial Sequence
  sgRNA
  Ssr1_6
ggatgctgtcttcaatcaga

SEQ ID NO: 58608 - DNA, 20 bp, Artificial Sequence
  sgRNA
  Ssr1_7
ggtggcactacagtgtttag

SEQ ID NO: 58609 - DNA, 20 bp, Artificial Sequence
  sgRNA
  Ssr1_8
ttgcacctgagaccaccgga

SEQ ID NO: 58610 - DNA, 20 bp, Artificial Sequence
  sgRNA
  Ssr1_9
ccgctggtctaagcaacttc

SEQ ID NO: 58611 - DNA, 20 bp, Artificial Sequence
  sgRNA
  Ssr1_10
ttcatccctgcagagccgat

SEQ ID NO: 58612 - DNA, 20 bp, Artificial Sequence
  sgRNA
  Ssr1_11
cttctcccagaaggcagccc

SEQ ID NO: 58613 - DNA, 20 bp, Artificial Sequence
  sgRNA
  Ssr1_12
gaagcgggcgcagaagcgat

SEQ ID NO: 58614 - DNA, 20 bp, Artificial Sequence
  sgRNA
  Ssr1_13
atctgattcaaagtctcctg

SEQ ID NO: 58615 - DNA, 20 bp, Artificial Sequence
  sgRNA
  Ssr1_14
cctgcagctcagccatccgg

SEQ ID NO: 58616 - DNA, 20 bp, Artificial Sequence
  sgRNA
  Ssr1_15
gtcaacatcattctgacttg

SEQ ID NO: 58617 - DNA, 20 bp, Artificial Sequence
  sgRNA
  Ssr1_16
ccttgtttgtaaagccaacc

SEQ ID NO: 58618 - DNA, 20 bp, Artificial Sequence
  sgRNA
  Ssr1_17
gagaagacatccaggccgca

SEQ ID NO: 58619 - DNA, 20 bp, Artificial Sequence
  sgRNA
  Ssr1_18
gcttagaccagcggcccctg

SEQ ID NO: 58620 - DNA, 20 bp, Artificial Sequence
  sgRNA
  Ssr1_19
ctcaaaagttgcctgccgct

SEQ ID NO: 58621 - DNA, 20 bp, Artificial Sequence
  sgRNA
  Ssr1_20
tggttggctttacaaacaag

SEQ ID NO: 58622 - DNA, 20 bp, Artificial Sequence
  sgRNA
  Sstr1_1
caatgatgagcacataacac

SEQ ID NO: 58623 - DNA, 20 bp, Artificial Sequence
  sgRNA
  Sstr1_2
ccagaatgggaccttaagcg

SEQ ID NO: 58624 - DNA, 20 bp, Artificial Sequence
  sgRNA
  Sstr1_3
gtggccaaagtagtgaacct

SEQ ID NO: 58625 - DNA, 20 bp, Artificial Sequence
  sgRNA
  Sstr1_4
gggccagtggcgcaacagcg

SEQ ID NO: 58626 - DNA, 20 bp, Artificial Sequence
  sgRNA
  Sstr1_5
ggtgcgtgagaagaccacga

SEQ ID NO: 58627 - DNA, 20 bp, Artificial Sequence
  sgRNA
  Sstr1_6
gcagtggcatagtagtcgac

SEQ ID NO: 58628 - DNA, 20 bp, Artificial Sequence
  sgRNA
  Sstr1_7
cggcaaagtagcgcgccgaa

SEQ ID NO: 58629 - DNA, 20 bp, Artificial Sequence
  sgRNA
  Sstr1_8
gaagagtcgagcctacagcg

SEQ ID NO: 58630 - DNA, 20 bp, Artificial Sequence
  sgRNA
  Sstr1_9
catcattgccaagatgcgca

SEQ ID NO: 58631 - DNA, 20 bp, Artificial Sequence
  sgRNA
  Sstr1_10
gctgtaggctcgactcttca

SEQ ID NO: 58632 - DNA, 20 bp, Artificial Sequence
  sgRNA
  Sstr1_11
catcctctacggcttcctgt

SEQ ID NO: 58633 - DNA, 20 bp, Artificial Sequence
  sgRNA
  Sstr1_12
tcaaggcagcgcgctaccgt

SEQ ID NO: 58634 - DNA, 20 bp, Artificial Sequence
  sgRNA
  Sstr1_13
catccacgctgagcaccagg

SEQ ID NO: 58635 - DNA, 20 bp, Artificial Sequence
  sgRNA
  Sstr1_14
gagtcgagcctacagcgtgg

SEQ ID NO: 58636 - DNA, 20 bp, Artificial Sequence
  sgRNA
  Sstr1_15
ctgctggatgcctttctacg

SEQ ID NO: 58637 - DNA, 20 bp, Artificial Sequence
  sgRNA
  Sstr1_16
gtgcgtgagaagaccacgat

SEQ ID NO: 58638 - DNA, 20 bp, Artificial Sequence
  sgRNA
  Sstr1_17
cagaatgggaccttaagcga

SEQ ID NO: 58639 - DNA, 20 bp, Artificial Sequence
  sgRNA
  Sstr1_18
ttgccgcctggtgctcagcg

SEQ ID NO: 58640 - DNA, 20 bp, Artificial Sequence
  sgRNA
  Sstr1_19
ggtgcaccacagccacatag

SEQ ID NO: 58641 - DNA, 20 bp, Artificial Sequence
  sgRNA
  Sstr1_20
cggcgcgctactttgccgcc

SEQ ID NO: 58642 - DNA, 20 bp, Artificial Sequence
  sgRNA
  Sstr2_1
ttgcccatcatgatatacgc

SEQ ID NO: 58643 - DNA, 20 bp, Artificial Sequence
  sgRNA
  Sstr2_2
ccacgaagtagatgaacgtg

SEQ ID NO: 58644 - DNA, 20 bp, Artificial Sequence
  sgRNA
  Sstr2_3
tgacttaatggggtgcacca

SEQ ID NO: 58645 - DNA, 20 bp, Artificial Sequence
  sgRNA
  Sstr2_4
tgatcccactcggattccag

SEQ ID NO: 58646 - DNA, 20 bp, Artificial Sequence
  sgRNA
  Sstr2_5
ggtcaaggtgagtggtacgg

SEQ ID NO: 58647 - DNA, 20 bp, Artificial Sequence
  sgRNA
  Sstr2_6
agacaattcacaatccggag

SEQ ID NO: 58648 - DNA, 20 bp, Artificial Sequence
  sgRNA
  Sstr2_7
ccactacgatggacaccatg

SEQ ID NO: 58649 - DNA, 20 bp, Artificial Sequence
  sgRNA
  Sstr2_8
ttgatcatcttggctgtccg

SEQ ID NO: 58650 - DNA, 20 bp, Artificial Sequence
  sgRNA
  Sstr2_9
ccgcatggtgtccatcgtag

SEQ ID NO: 58651 - DNA, 20 bp, Artificial Sequence
  sgRNA
  Sstr2_10
gaaacctgtgtaccacgccc

SEQ ID NO: 58652 - DNA, 20 bp, Artificial Sequence
  sgRNA
  Sstr2_11
caactggccaggcgaatccg

SEQ ID NO: 58653 - DNA, 20 bp, Artificial Sequence
  sgRNA
  Sstr2_12
gttgaatgggagccaagtgt

SEQ ID NO: 58654 - DNA, 20 bp, Artificial Sequence
  sgRNA
  Sstr2_13
ttatctacgccttcatcctg

SEQ ID NO: 58655 - DNA, 20 bp, Artificial Sequence
  sgRNA
  Sstr2_14
aggccggcgtatatcatgat

SEQ ID NO: 58656 - DNA, 20 bp, Artificial Sequence
  sgRNA
  Sstr2_15
tgtcatgtcgtagtatggct

SEQ ID NO: 58657 - DNA, 20 bp, Artificial Sequence
  sgRNA
  Sstr2_16
gaagtcctctggaatccgag

SEQ ID NO: 58658 - DNA, 20 bp, Artificial Sequence
  sgRNA
  Sstr2_17
gatgaagacagccactacga

SEQ ID NO: 58659 - DNA, 20 bp, Artificial Sequence
  sgRNA
  Sstr2_18
agatgatcaatgtagctgtg

SEQ ID NO: 58660 - DNA, 20 bp, Artificial Sequence
  sgRNA
  Sstr2_19
gagacgttgaagatgtagaa

SEQ ID NO: 58661 - DNA, 20 bp, Artificial Sequence
  sgRNA
  Sstr2_20
gccacctgcatggccaagaa

SEQ ID NO: 58662 - DNA, 20 bp, Artificial Sequence
  sgRNA
  Sstr3_1
aggtgcggtcgaccacccgg

SEQ ID NO: 58663 - DNA, 20 bp, Artificial Sequence
  sgRNA
  Sstr3_2
tggcacgtgctcatgccccg

SEQ ID NO: 58664 - DNA, 20 bp, Artificial Sequence
  sgRNA
  Sstr3_3
caactcgctggtgatctacg

SEQ ID NO: 58665 - DNA, 20 bp, Artificial Sequence
  sgRNA
  Sstr3_4
ggtccacactcatgacggtg

SEQ ID NO: 58666 - DNA, 20 bp, Artificial Sequence
  sgRNA
  Sstr3_5
cggcacatgagagatccgaa

SEQ ID NO: 58667 - DNA, 20 bp, Artificial Sequence
  sgRNA
  Sstr3_6
ggtgcaccacagccagatag

SEQ ID NO: 58668 - DNA, 20 bp, Artificial Sequence
  sgRNA
  Sstr3_7
gtgccgtctggtcatggccg

SEQ ID NO: 58669 - DNA, 20 bp, Artificial Sequence
  sgRNA
  Sstr3_8
gcactagtggacaacagcca

SEQ ID NO: 58670 - DNA, 20 bp, Artificial Sequence
  sgRNA
  Sstr3_9
ggtgtacctggtggtgtgcg

SEQ ID NO: 58671 - DNA, 20 bp, Artificial Sequence
  sgRNA
  Sstr3_10
gcctgtacccactgacacga

SEQ ID NO: 58672 - DNA, 20 bp, Artificial Sequence
  sgRNA
  Sstr3_11
gatagaaaggcatccagcag

SEQ ID NO: 58673 - DNA, 20 bp, Artificial Sequence
  sgRNA
  Sstr3_12
atagcggtccacactcatga

SEQ ID NO: 58674 - DNA, 20 bp, Artificial Sequence
  sgRNA
  Sstr3_13
gcagtccctgtgcagggccg

SEQ ID NO: 58675 - DNA, 20 bp, Artificial Sequence
  sgRNA
  Sstr3_14
tgcgaaagccctgcttgaag

SEQ ID NO: 58676 - DNA, 20 bp, Artificial Sequence
  sgRNA
  Sstr3_15
cttgtgctacttgctcattg

SEQ ID NO: 58677 - DNA, 20 bp, Artificial Sequence
  sgRNA
  Sstr3_16
gccagcggatgtgttcccca

SEQ ID NO: 58678 - DNA, 20 bp, Artificial Sequence
  sgRNA
  Sstr3_17
tttgcgcagctgttggcgta

SEQ ID NO: 58679 - DNA, 20 bp, Artificial Sequence
  sgRNA
  Sstr3_18
tgctcattgtggtaaaggtg

SEQ ID NO: 58680 - DNA, 20 bp, Artificial Sequence
  sgRNA
  Sstr3_19
gtgtgaccctgcgctcagag

SEQ ID NO: 58681 - DNA, 20 bp, Artificial Sequence
  sgRNA
  Sstr3_20
taaaggtgcggtcgaccacc

SEQ ID NO: 58682 - DNA, 20 bp, Artificial Sequence
  sgRNA
  Sstr4_1
aagcaggtagcataatccga

SEQ ID NO: 58683 - DNA, 20 bp, Artificial Sequence
  sgRNA
  Sstr4_2
gtggccaagctaatcaacct

SEQ ID NO: 58684 - DNA, 20 bp, Artificial Sequence
  sgRNA
  Sstr4_3
gtgtcgcgcagtgcttagcg

SEQ ID NO: 58685 - DNA, 20 bp, Artificial Sequence
  sgRNA
  Sstr4_4
cagctgggctccggacgagg

SEQ ID NO: 58686 - DNA, 20 bp, Artificial Sequence
  sgRNA
  Sstr4_5
gcagtggcatagtagtccag

SEQ ID NO: 58687 - DNA, 20 bp, Artificial Sequence
  sgRNA
  Sstr4_6
gcatcttgcccacaataagc

SEQ ID NO: 58688 - DNA, 20 bp, Artificial Sequence
  sgRNA
  Sstr4_7
tcttcatcttggcatagcgt

SEQ ID NO: 58689 - DNA, 20 bp, Artificial Sequence
  sgRNA
  Sstr4_8
gtgtcagcgaagactgcgat

SEQ ID NO: 58690 - DNA, 20 bp, Artificial Sequence
  sgRNA
  Sstr4_9
ccagctggcgttgatcccag

SEQ ID NO: 58691 - DNA, 20 bp, Artificial Sequence
  sgRNA
  Sstr4_10
cgacacagcaccgccccgaa

SEQ ID NO: 58692 - DNA, 20 bp, Artificial Sequence
  sgRNA
  Sstr4_11
ggtgcacaacagccacatag

SEQ ID NO: 58693 - DNA, 20 bp, Artificial Sequence
  sgRNA
  Sstr4_12
gggctggctggcaacaacgg

SEQ ID NO: 58694 - DNA, 20 bp, Artificial Sequence
  sgRNA
  Sstr4_13
tgtctcctggaaacaactgg

SEQ ID NO: 58695 - DNA, 20 bp, Artificial Sequence
  sgRNA
  Sstr4_14
gctgagcatgaagagctcat

SEQ ID NO: 58696 - DNA, 20 bp, Artificial Sequence
  sgRNA
  Sstr4_15
cttccggcgctctttccagc

SEQ ID NO: 58697 - DNA, 20 bp, Artificial Sequence
  sgRNA
  Sstr4_16
gaacccgctggaaagagcgc

SEQ ID NO: 58698 - DNA, 20 bp, Artificial Sequence
  sgRNA
  Sstr4_17
ataatccgatggccagaacc

SEQ ID NO: 58699 - DNA, 20 bp, Artificial Sequence
  sgRNA
  Sstr4_18
gtggtgtcctcgacccccgg

SEQ ID NO: 58700 - DNA, 20 bp, Artificial Sequence
  sgRNA
  Sstr4_19
ggtgtcagcgaagactgcga

SEQ ID NO: 58701 - DNA, 20 bp, Artificial Sequence
  sgRNA
  Sstr4_20
ttgttgccagccagcccgca

SEQ ID NO: 58702 - DNA, 20 bp, Artificial Sequence
  sgRNA
  Sstr5_1
cataaacaacacgtcagcca

SEQ ID NO: 58703 - DNA, 20 bp, Artificial Sequence
  sgRNA
  Sstr5_2
cataccaacaagtagagcac

SEQ ID NO: 58704 - DNA, 20 bp, Artificial Sequence
  sgRNA
  Sstr5_3
tgcgtgtgggctcctcacgg

SEQ ID NO: 58705 - DNA, 20 bp, Artificial Sequence
  sgRNA
  Sstr5_4
tgagcggagagggtggacca

SEQ ID NO: 58706 - DNA, 20 bp, Artificial Sequence
  sgRNA
  Sstr5_5
gcacaggcactaataccgcc

SEQ ID NO: 58707 - DNA, 20 bp, Artificial Sequence
  sgRNA
  Sstr5_6
cgtccagcgtcatgaccagg

SEQ ID NO: 58708 - DNA, 20 bp, Artificial Sequence
  sgRNA
  Sstr5_7
gtatatcctgaacctggccg

SEQ ID NO: 58709 - DNA, 20 bp, Artificial Sequence
  sgRNA
  Sstr5_8
aataccgcccgggctcccat

SEQ ID NO: 58710 - DNA, 20 bp, Artificial Sequence
  sgRNA
  Sstr5_9
ggaccaccacaaagaagtag

SEQ ID NO: 58711 - DNA, 20 bp, Artificial Sequence
  sgRNA
  Sstr5_10
ccacaccgtatcctctacgt

SEQ ID NO: 58712 - DNA, 20 bp, Artificial Sequence
  sgRNA
  Sstr5_11
tgtgtttccacccagtccca

SEQ ID NO: 58713 - DNA, 20 bp, Artificial Sequence
  sgRNA
  Sstr5_12
atgcagatgccatagagcca

SEQ ID NO: 58714 - DNA, 20 bp, Artificial Sequence
  sgRNA
  Sstr5_13
cggcacaagaaggagccaaa

SEQ ID NO: 58715 - DNA, 20 bp, Artificial Sequence
  sgRNA
  Sstr5_14
ctagccagcttggctacccg

SEQ ID NO: 58716 - DNA, 20 bp, Artificial Sequence
  sgRNA
  Sstr5_15
gagccttccggaaactctgg

SEQ ID NO: 58717 - DNA, 20 bp, Artificial Sequence
  sgRNA
  Sstr5_16
gagcagcgagaagacccaga

SEQ ID NO: 58718 - DNA, 20 bp, Artificial Sequence
  sgRNA
  Sstr5_17
acatccgcaaagaccaagag

SEQ ID NO: 58719 - DNA, 20 bp, Artificial Sequence
  sgRNA
  Sstr5_18
cttccgccagagtttccgga

SEQ ID NO: 58720 - DNA, 20 bp, Artificial Sequence
  sgRNA
  Sstr5_19
acgcaaggtgactcgcatgg

SEQ ID NO: 58721 - DNA, 20 bp, Artificial Sequence
  sgRNA
  Sstr5_20
gcggaggcgctcagaacgca

SEQ ID NO: 58722 - DNA, 20 bp, Artificial Sequence
  sgRNA
  Stab1_1
gtgtgcaaaaacgacgaggt

SEQ ID NO: 58723 - DNA, 20 bp, Artificial Sequence
  sgRNA
  Stab1_2
gcttgtgtttcgctaccacg

SEQ ID NO: 58724 - DNA, 20 bp, Artificial Sequence
  sgRNA
  Stab1_3
gcgacatcacgtgatccttg

SEQ ID NO: 58725 - DNA, 20 bp, Artificial Sequence
  sgRNA
  Stab1_4
catccgtagactgagcctcg

SEQ ID NO: 58726 - DNA, 20 bp, Artificial Sequence
  sgRNA
  Stab1_5
taacacagtgagcgtccgag

SEQ ID NO: 58727 - DNA, 20 bp, Artificial Sequence
  sgRNA
  Stab1_6
gccgacagcatgtcatcgca

SEQ ID NO: 58728 - DNA, 20 bp, Artificial Sequence
  sgRNA
  Stab1_7
atacggtcactgctctacga

SEQ ID NO: 58729 - DNA, 20 bp, Artificial Sequence
  sgRNA
  Stab1_8
gcagccacttaaggatatcg

SEQ ID NO: 58730 - DNA, 20 bp, Artificial Sequence
  sgRNA
  Stab1_9
tgtcactgctgccaaaaaca

SEQ ID NO: 58731 - DNA, 20 bp, Artificial Sequence
  sgRNA
  Stab1_10
ttaacaacaacgcttctgag

SEQ ID NO: 58732 - DNA, 20 bp, Artificial Sequence
  sgRNA
  Stab1_11
gtatcctgcagcacagacgc

SEQ ID NO: 58733 - DNA, 20 bp, Artificial Sequence
  sgRNA
  Stab1_12
gtaagctccacgcattgaga

SEQ ID NO: 58734 - DNA, 20 bp, Artificial Sequence
  sgRNA
  Stab1_13
tgatgtcccacacgatgacg

SEQ ID NO: 58735 - DNA, 20 bp, Artificial Sequence
  sgRNA
  Stab1_14
gcttccggcagccaaccacg

SEQ ID NO: 58736 - DNA, 20 bp, Artificial Sequence
  sgRNA
  Stab1_15
ggccaactccgaaccatgca

SEQ ID NO: 58737 - DNA, 20 bp, Artificial Sequence
  sgRNA
  Stab1_16
ggatataaacgcactccttg

SEQ ID NO: 58738 - DNA, 20 bp, Artificial Sequence
  sgRNA
  Stab1_17
ggttagccacgtcatcgtgt

SEQ ID NO: 58739 - DNA, 20 bp, Artificial Sequence
  sgRNA
  Stab1_18
tctactccatgaggttcgga

SEQ ID NO: 58740 - DNA, 20 bp, Artificial Sequence
  sgRNA
  Stab1_19
ccttgctcgcgcccagaccg

SEQ ID NO: 58741 - DNA, 20 bp, Artificial Sequence
  sgRNA
  Stab1_20
tctggattgtctttctcccg

SEQ ID NO: 58742 - DNA, 20 bp, Artificial Sequence
  sgRNA
  Stab2_1
aatgcatccaagctagcacg

SEQ ID NO: 58743 - DNA, 20 bp, Artificial Sequence
  sgRNA
  Stab2_2
gcagattctggcaaacaacg

SEQ ID NO: 58744 - DNA, 20 bp, Artificial Sequence
  sgRNA
  Stab2_3
tcctgccgcacatttgcacg

SEQ ID NO: 58745 - DNA, 20 bp, Artificial Sequence
  sgRNA
  Stab2_4
aggtaggaacaacttgcgtg

SEQ ID NO: 58746 - DNA, 20 bp, Artificial Sequence
  sgRNA
  Stab2_5
ggtgatggaatcgtctgccg

SEQ ID NO: 58747 - DNA, 20 bp, Artificial Sequence
  sgRNA
  Stab2_6
gcatatcctcgacagagcga

SEQ ID NO: 58748 - DNA, 20 bp, Artificial Sequence
  sgRNA
  Stab2_7
tcacaggagccatctcccga

SEQ ID NO: 58749 - DNA, 20 bp, Artificial Sequence
  sgRNA
  Stab2_8
cggagactcttgtttgacgg

SEQ ID NO: 58750 - DNA, 20 bp, Artificial Sequence
  sgRNA
  Stab2_9
gattctacggtatcacgtgg

SEQ ID NO: 58751 - DNA, 20 bp, Artificial Sequence
  sgRNA
  Stab2_10
ccagattctacggtatcacg

SEQ ID NO: 58752 - DNA, 20 bp, Artificial Sequence
  sgRNA
  Stab2_11
tttgtatgagacctcaacgc

SEQ ID NO: 58753 - DNA, 20 bp, Artificial Sequence
  sgRNA
  Stab2_12
aagtaaccactgcagcaccg

SEQ ID NO: 58754 - DNA, 20 bp, Artificial Sequence
  sgRNA
  Stab2_13
ttaaaggcagcagcttgccg

SEQ ID NO: 58755 - DNA, 20 bp, Artificial Sequence
  sgRNA
  Stab2_14
gcgttgaggtctcatacaaa

SEQ ID NO: 58756 - DNA, 20 bp, Artificial Sequence
  sgRNA
  Stab2_15
gataacagactggacagcga

SEQ ID NO: 58757 - DNA, 20 bp, Artificial Sequence
  sgRNA
  Stab2_16
tgacaatgcagccacaaacg

SEQ ID NO: 58758 - DNA, 20 bp, Artificial Sequence
  sgRNA
  Stab2_17
acaacaatgtgtctatgacg

SEQ ID NO: 58759 - DNA, 20 bp, Artificial Sequence
  sgRNA
  Stab2_18
gacacaccgtgtaacaaccg

SEQ ID NO: 58760 - DNA, 20 bp, Artificial Sequence
  sgRNA
  Stab2_19
ggaacatagttgcttcaaat

SEQ ID NO: 58761 - DNA, 20 bp, Artificial Sequence
  sgRNA
  Stab2_20
cacatgccccggttgttaca

SEQ ID NO: 58762 - DNA, 20 bp, Artificial Sequence
  sgRNA
  Steap4_1
tgtgtactgtgcaatacgag

SEQ ID NO: 58763 - DNA, 20 bp, Artificial Sequence
  sgRNA
  Steap4_2
gataatcaactagttccgtg

SEQ ID NO: 58764 - DNA, 20 bp, Artificial Sequence
  sgRNA
  Steap4_3
aataccagggaggtacacca

SEQ ID NO: 58765 - DNA, 20 bp, Artificial Sequence
  sgRNA
  Steap4_4
gttaaatgctttgaccacgt

SEQ ID NO: 58766 - DNA, 20 bp, Artificial Sequence
  sgRNA
  Steap4_5
gcctccatcgaacatagtaa

SEQ ID NO: 58767 - DNA, 20 bp, Artificial Sequence
  sgRNA
  Steap4_6
gcctcgatagagctgcagaa

SEQ ID NO: 58768 - DNA, 20 bp, Artificial Sequence
  sgRNA
  Steap4_7
gtgccaaaatataagccgaa

SEQ ID NO: 58769 - DNA, 20 bp, Artificial Sequence
  sgRNA
  Steap4_8
ggctccaccttagaatcgaa

SEQ ID NO: 58770 - DNA, 20 bp, Artificial Sequence
  sgRNA
  Steap4_9
aacactagatgcaagccggc

SEQ ID NO: 58771 - DNA, 20 bp, Artificial Sequence
  sgRNA
  Steap4_10
gccctggcggatgcgagtga

SEQ ID NO: 58772 - DNA, 20 bp, Artificial Sequence
  sgRNA
  Steap4_11
agagcactatgattccctca

SEQ ID NO: 58773 - DNA, 20 bp, Artificial Sequence
  sgRNA
  Steap4_12
tctaaggtggagcctccctt

SEQ ID NO: 58774 - DNA, 20 bp, Artificial Sequence
  sgRNA
  Steap4_13
gctggagccaggagcccacg

SEQ ID NO: 58775 - DNA, 20 bp, Artificial Sequence
  sgRNA
  Steap4_14
gtgagggtcttgtctatgca

SEQ ID NO: 58776 - DNA, 20 bp, Artificial Sequence
  sgRNA
  Steap4_15
gtgggctgtgcacaagacca

SEQ ID NO: 58777 - DNA, 20 bp, Artificial Sequence
  sgRNA
  Steap4_16
gaatggcagcgagaatacca

SEQ ID NO: 58778 - DNA, 20 bp, Artificial Sequence
  sgRNA
  Steap4_17
tctgaggaatcagtagtcag

SEQ ID NO: 58779 - DNA, 20 bp, Artificial Sequence
  sgRNA
  Steap4_18
acattggaaatagttgcaga

SEQ ID NO: 58780 - DNA, 20 bp, Artificial Sequence
  sgRNA
  Steap4_19
agtgccaaaatataagccga

SEQ ID NO: 58781 - DNA, 20 bp, Artificial Sequence
  sgRNA
  Steap4_20
gtgtccagccttctgcccag

SEQ ID NO: 58782 - DNA, 20 bp, Artificial Sequence
  sgRNA
  Stim1_1
tgaggataagcttatcagcg

SEQ ID NO: 58783 - DNA, 20 bp, Artificial Sequence
  sgRNA
  Stim1_2
gaatacaggagctagctccg

SEQ ID NO: 58784 - DNA, 20 bp, Artificial Sequence
  sgRNA
  Stim1_3
gagccgtcaaaaatatgctg

SEQ ID NO: 58785 - DNA, 20 bp, Artificial Sequence
  sgRNA
  Stim1_4
cagcagatcgagatcctctg

SEQ ID NO: 58786 - DNA, 20 bp, Artificial Sequence
  sgRNA
  Stim1_5
agtaagctgcaacttccgga

SEQ ID NO: 58787 - DNA, 20 bp, Artificial Sequence
  sgRNA
  Stim1_6
ggactgatcatccgagccgg

SEQ ID NO: 58788 - DNA, 20 bp, Artificial Sequence
  sgRNA
  Stim1_7
cagcttatggatgtttcgga

SEQ ID NO: 58789 - DNA, 20 bp, Artificial Sequence
  sgRNA
  Stim1_8
agactcttcagaagtcgccc

SEQ ID NO: 58790 - DNA, 20 bp, Artificial Sequence
  sgRNA
  Stim1_9
gactcggcataatcacctga

SEQ ID NO: 58791 - DNA, 20 bp, Artificial Sequence
  sgRNA
  Stim1_10
ggaagtagagaaggtccacc

SEQ ID NO: 58792 - DNA, 20 bp, Artificial Sequence
  sgRNA
  Stim1_11
ggaccccctcaatcagccga

SEQ ID NO: 58793 - DNA, 20 bp, Artificial Sequence
  sgRNA
  Stim1_12
ttactggccacgccatgcca

SEQ ID NO: 58794 - DNA, 20 bp, Artificial Sequence
  sgRNA
  Stim1_13
ctaccaacctctgagatccc

SEQ ID NO: 58795 - DNA, 20 bp, Artificial Sequence
  sgRNA
  Stim1_14
ggtaattgaggtcttccctt

SEQ ID NO: 58796 - DNA, 20 bp, Artificial Sequence
  sgRNA
  Stim1_15
ggatctcgatctgctgccac

SEQ ID NO: 58797 - DNA, 20 bp, Artificial Sequence
  sgRNA
  Stim1_16
gctcggatgatcagtccctc

SEQ ID NO: 58798 - DNA, 20 bp, Artificial Sequence
  sgRNA
  Stim1_17
tgacaagccgggtatctctg

SEQ ID NO: 58799 - DNA, 20 bp, Artificial Sequence
  sgRNA
  Stim1_18
ggggacaaccgagctctgca

SEQ ID NO: 58800 - DNA, 20 bp, Artificial Sequence
  sgRNA
  Stim1_19
atacccggcttgtcaagaag

SEQ ID NO: 58801 - DNA, 20 bp, Artificial Sequence
  sgRNA
  Stim1_20
tgataagcttatcctcacca

SEQ ID NO: 58802 - DNA, 20 bp, Artificial Sequence
  sgRNA
  Stt3b_1
agggtacatatctcggtcag

SEQ ID NO: 58803 - DNA, 20 bp, Artificial Sequence
  sgRNA
  Stt3b_2
cgacagcatgcagacgaccg

SEQ ID NO: 58804 - DNA, 20 bp, Artificial Sequence
  sgRNA
  Stt3b_3
gtcatctatctgacatacac

SEQ ID NO: 58805 - DNA, 20 bp, Artificial Sequence
  sgRNA
  Stt3b_4
tacagcaagagagtctacat

SEQ ID NO: 58806 - DNA, 20 bp, Artificial Sequence
  sgRNA
  Stt3b_5
gcttcattgctatcgtacca

SEQ ID NO: 58807 - DNA, 20 bp, Artificial Sequence
  sgRNA
  Stt3b_6
tcatccacgagttcgacccg

SEQ ID NO: 58808 - DNA, 20 bp, Artificial Sequence
  sgRNA
  Stt3b_7
cgtggatgatgctctcgaag

SEQ ID NO: 58809 - DNA, 20 bp, Artificial Sequence
  sgRNA
  Stt3b_8
gttcgcggtccactgcacgt

SEQ ID NO: 58810 - DNA, 20 bp, Artificial Sequence
  sgRNA
  Stt3b_9
cgtccctcaactcgtccccg

SEQ ID NO: 58811 - DNA, 20 bp, Artificial Sequence
  sgRNA
  Stt3b_10
cattgtccagaacacagacc

SEQ ID NO: 58812 - DNA, 20 bp, Artificial Sequence
  sgRNA
  Stt3b_11
catcagccgcaccatcactc

SEQ ID NO: 58813 - DNA, 20 bp, Artificial Sequence
  sgRNA
  Stt3b_12
actgaccgagatatgtaccc

SEQ ID NO: 58814 - DNA, 20 bp, Artificial Sequence
  sgRNA
  Stt3b_13
gggacgatgttggtgactcg

SEQ ID NO: 58815 - DNA, 20 bp, Artificial Sequence
  sgRNA
  Stt3b_14
cgacttgtgcttgctctccg

SEQ ID NO: 58816 - DNA, 20 bp, Artificial Sequence
  sgRNA
  Stt3b_15
cagctgttatcatcaaccct

SEQ ID NO: 58817 - DNA, 20 bp, Artificial Sequence
  sgRNA
  Stt3b_16
agagccatgaggccgctcca

SEQ ID NO: 58818 - DNA, 20 bp, Artificial Sequence
  sgRNA
  Stt3b_17
gcaacacaaacacatggaga

SEQ ID NO: 58819 - DNA, 20 bp, Artificial Sequence
  sgRNA
  Stt3b_18
aggagtgattggctattccg

SEQ ID NO: 58820 - DNA, 20 bp, Artificial Sequence
  sgRNA
  Stt3b_19
aaacacggatgaacacgccc

SEQ ID NO: 58821 - DNA, 20 bp, Artificial Sequence
  sgRNA
  Stt3b_20
agccatgaggccgctccacg

SEQ ID NO: 58822 - DNA, 20 bp, Artificial Sequence
  sgRNA
  Sucnr1_1
cgattgcataaaatgcagag

SEQ ID NO: 58823 - DNA, 20 bp, Artificial Sequence
  sgRNA
  Sucnr1_2
tatacagagaacatctccat

SEQ ID NO: 58824 - DNA, 20 bp, Artificial Sequence
  sgRNA
  Sucnr1_3
tagaacttctaaggtcacta

SEQ ID NO: 58825 - DNA, 20 bp, Artificial Sequence
  sgRNA
  Sucnr1_4
ggtccatgctaatgaaagtg

SEQ ID NO: 58826 - DNA, 20 bp, Artificial Sequence
  sgRNA
  Sucnr1_5
ggttggtgtgaagcacatat

SEQ ID NO: 58827 - DNA, 20 bp, Artificial Sequence
  sgRNA
  Sucnr1_6
gcataactctttatcaggat

SEQ ID NO: 58828 - DNA, 20 bp, Artificial Sequence
  sgRNA
  Sucnr1_7
gaattgatgaaagtgagcat

SEQ ID NO: 58829 - DNA, 20 bp, Artificial Sequence
  sgRNA
  Sucnr1_8
ggtacttcatgagcagatat

SEQ ID NO: 58830 - DNA, 20 bp, Artificial Sequence
  sgRNA
  Sucnr1_9
agagttatgccaatgataag

SEQ ID NO: 58831 - DNA, 20 bp, Artificial Sequence
  sgRNA
  Sucnr1_10
gccttctgtgtacatccttg

SEQ ID NO: 58832 - DNA, 20 bp, Artificial Sequence
  sgRNA
  Sucnr1_11
gtagaaagtgttctcggaaa

SEQ ID NO: 58833 - DNA, 20 bp, Artificial Sequence
  sgRNA
  Sucnr1_12
tgagaattggttggcaacag

SEQ ID NO: 58834 - DNA, 20 bp, Artificial Sequence
  sgRNA
  Sucnr1_13
gtgcttcttctactacaaga

SEQ ID NO: 58835 - DNA, 20 bp, Artificial Sequence
  sgRNA
  Sucnr1_14
ggacaaaccccaacgcctgg

SEQ ID NO: 58836 - DNA, 20 bp, Artificial Sequence
  sgRNA
  Sucnr1_15
tcacaactgccaggaccacc

SEQ ID NO: 58837 - DNA, 20 bp, Artificial Sequence
  sgRNA
  Sucnr1_16
tcaagtcccttacatccttc

SEQ ID NO: 58838 - DNA, 20 bp, Artificial Sequence
  sgRNA
  Sucnr1_17
actctttatcaggatgggaa

SEQ ID NO: 58839 - DNA, 20 bp, Artificial Sequence
  sgRNA
  Sucnr1_18
ggcataactctttatcagga

SEQ ID NO: 58840 - DNA, 20 bp, Artificial Sequence
  sgRNA
  Sucnr1_19
actggacaaaccccaacgcc

SEQ ID NO: 58841 - DNA, 20 bp, Artificial Sequence
  sgRNA
  Sucnr1_20
cttcctcactttcattagca

SEQ ID NO: 58842 - DNA, 20 bp, Artificial Sequence
  sgRNA
  Suco_1
ttgcatccgtcttctaatgg

SEQ ID NO: 58843 - DNA, 20 bp, Artificial Sequence
  sgRNA
  Suco_2
tcagtgagtgagcaagacgg

SEQ ID NO: 58844 - DNA, 20 bp, Artificial Sequence
  sgRNA
  Suco_3
aaaactgaagacttgacaga

SEQ ID NO: 58845 - DNA, 20 bp, Artificial Sequence
  sgRNA
  Suco_4
gcatttgataaatcacacag

SEQ ID NO: 58846 - DNA, 20 bp, Artificial Sequence
  sgRNA
  Suco_5
tccacagtattataatccag

SEQ ID NO: 58847 - DNA, 20 bp, Artificial Sequence
  sgRNA
  Suco_6
gcatacatctgttcatccag

SEQ ID NO: 58848 - DNA, 20 bp, Artificial Sequence
  sgRNA
  Suco_7
tgtagcagaattaaagcggg

SEQ ID NO: 58849 - DNA, 20 bp, Artificial Sequence
  sgRNA
  Suco_8
tgtgatttatcaaatgcccc

SEQ ID NO: 58850 - DNA, 20 bp, Artificial Sequence
  sgRNA
  Suco_9
ggagtgcttcaaccacaggg

SEQ ID NO: 58851 - DNA, 20 bp, Artificial Sequence
  sgRNA
  Suco_10
aggaaacaaggagatcaccg

SEQ ID NO: 58852 - DNA, 20 bp, Artificial Sequence
  sgRNA
  Suco_11
gagaatgtgtcatcttcaca

SEQ ID NO: 58853 - DNA, 20 bp, Artificial Sequence
  sgRNA
  Suco_12
tttggcaccacactccacag

SEQ ID NO: 58854 - DNA, 20 bp, Artificial Sequence
  sgRNA
  Suco_13
tgtggacctccattagaaga

SEQ ID NO: 58855 - DNA, 20 bp, Artificial Sequence
  sgRNA
  Suco_14
ccgagctgccctcagacgga

SEQ ID NO: 58856 - DNA, 20 bp, Artificial Sequence
  sgRNA
  Suco_15
tcagtaccgcagcctcccag

SEQ ID NO: 58857 - DNA, 20 bp, Artificial Sequence
  sgRNA
  Suco_16
gattgtacaactggttcagg

SEQ ID NO: 58858 - DNA, 20 bp, Artificial Sequence
  sgRNA
  Suco_17
ctatccacatcgccactggg

SEQ ID NO: 58859 - DNA, 20 bp, Artificial Sequence
  sgRNA
  Suco_18
ctgacgttctgactgatact

SEQ ID NO: 58860 - DNA, 20 bp, Artificial Sequence
  sgRNA
  Suco_19
tctggtggactgacaaaagc

SEQ ID NO: 58861 - DNA, 20 bp, Artificial Sequence
  sgRNA
  Suco_20
tcttgggtcatcaattgtga

SEQ ID NO: 58862 - DNA, 20 bp, Artificial Sequence
  sgRNA
  Susd1_1
ttatcgtgtaatcagtagcg

SEQ ID NO: 58863 - DNA, 20 bp, Artificial Sequence
  sgRNA
  Susd1_2
cacagaaagtgccgtcattg

SEQ ID NO: 58864 - DNA, 20 bp, Artificial Sequence
  sgRNA
  Susd1_3
acgatgtggcatccgtgcgt

SEQ ID NO: 58865 - DNA, 20 bp, Artificial Sequence
  sgRNA
  Susd1_4
cctcccaagttacattgcca

SEQ ID NO: 58866 - DNA, 20 bp, Artificial Sequence
  sgRNA
  Susd1_5
actttcctcagcgtgaagcg

SEQ ID NO: 58867 - DNA, 20 bp, Artificial Sequence
  sgRNA
  Susd1_6
tggcgttctgaatttcagga

SEQ ID NO: 58868 - DNA, 20 bp, Artificial Sequence
  sgRNA
  Susd1_7
agaacaaatgtaccaagtgg

SEQ ID NO: 58869 - DNA, 20 bp, Artificial Sequence
  sgRNA
  Susd1_8
tctcgttgttatttgtggcc

SEQ ID NO: 58870 - DNA, 20 bp, Artificial Sequence
  sgRNA
  Susd1_9
acttatttgccatctcacac

SEQ ID NO: 58871 - DNA, 20 bp, Artificial Sequence
  sgRNA
  Susd1_10
ggttgtcaggtagatgacca

SEQ ID NO: 58872 - DNA, 20 bp, Artificial Sequence
  sgRNA
  Susd1_11
gtggttcccacagatcacag

SEQ ID NO: 58873 - DNA, 20 bp, Artificial Sequence
  sgRNA
  Susd1_12
atataccgaaatattagcga

SEQ ID NO: 58874 - DNA, 20 bp, Artificial Sequence
  sgRNA
  Susd1_13
ggctcattatgactgtcagg

SEQ ID NO: 58875 - DNA, 20 bp, Artificial Sequence
  sgRNA
  Susd1_14
agttcctgagggctacgtcg

SEQ ID NO: 58876 - DNA, 20 bp, Artificial Sequence
  sgRNA
  Susd1_15
gagacgttcatccccaatga

SEQ ID NO: 58877 - DNA, 20 bp, Artificial Sequence
  sgRNA
  Susd1_16
ctcacagcgcagcagatggt

SEQ ID NO: 58878 - DNA, 20 bp, Artificial Sequence
  sgRNA
  Susd1_17
agaaccctccaggcgtgttg

SEQ ID NO: 58879 - DNA, 20 bp, Artificial Sequence
  sgRNA
  Susd1_18
gggaggttcccacacaccca

SEQ ID NO: 58880 - DNA, 20 bp, Artificial Sequence
  sgRNA
  Susd1_19
agccctcaggaacttcagga

SEQ ID NO: 58881 - DNA, 20 bp, Artificial Sequence
  sgRNA
  Susd1_20
gcctgtgcagacatggaggg

SEQ ID NO: 58882 - DNA, 20 bp, Artificial Sequence
  sgRNA
  Susd2_1
ggccggcgcttcatataacg

SEQ ID NO: 58883 - DNA, 20 bp, Artificial Sequence
  sgRNA
  Susd2_2
ctgcccggaagtcgtcaccc

SEQ ID NO: 58884 - DNA, 20 bp, Artificial Sequence
  sgRNA
  Susd2_3
agtgccgtagtattgccaat

SEQ ID NO: 58885 - DNA, 20 bp, Artificial Sequence
  sgRNA
  Susd2_4
aagtgaagaagccggtattg

SEQ ID NO: 58886 - DNA, 20 bp, Artificial Sequence
  sgRNA
  Susd2_5
gttgcagctgaatcggacaa

SEQ ID NO: 58887 - DNA, 20 bp, Artificial Sequence
  sgRNA
  Susd2_6
aggccagcaatgctgctaca

SEQ ID NO: 58888 - DNA, 20 bp, Artificial Sequence
  sgRNA
  Susd2_7
cgtatgcacctaccacccag

SEQ ID NO: 58889 - DNA, 20 bp, Artificial Sequence
  sgRNA
  Susd2_8
agtggcagcacccctgaccg

SEQ ID NO: 58890 - DNA, 20 bp, Artificial Sequence
  sgRNA
  Susd2_9
gtacagataggaccacttcg

SEQ ID NO: 58891 - DNA, 20 bp, Artificial Sequence
  sgRNA
  Susd2_10
gatgacttcaccctgcgcaa

SEQ ID NO: 58892 - DNA, 20 bp, Artificial Sequence
  sgRNA
  Susd2_11
gcttgggtccgtacacgaat

SEQ ID NO: 58893 - DNA, 20 bp, Artificial Sequence
  sgRNA
  Susd2_12
atagccgctttcatagagca

SEQ ID NO: 58894 - DNA, 20 bp, Artificial Sequence
  sgRNA
  Susd2_13
aatgctgctacacggcagca

SEQ ID NO: 58895 - DNA, 20 bp, Artificial Sequence
  sgRNA
  Susd2_14
ttatgcccgtttgcaggtgg

SEQ ID NO: 58896 - DNA, 20 bp, Artificial Sequence
  sgRNA
  Susd2_15
attcggatgtgatagaggtg

SEQ ID NO: 58897 - DNA, 20 bp, Artificial Sequence
  sgRNA
  Susd2_16
caggacctgcccattgcgca

SEQ ID NO: 58898 - DNA, 20 bp, Artificial Sequence
  sgRNA
  Susd2_17
ctagccaagtgcctgcatga

SEQ ID NO: 58899 - DNA, 20 bp, Artificial Sequence
  sgRNA
  Susd2_18
ggctgagtgtggtctcatca

SEQ ID NO: 58900 - DNA, 20 bp, Artificial Sequence
  sgRNA
  Susd2_19
ctgacttcagactcgacaag

SEQ ID NO: 58901 - DNA, 20 bp, Artificial Sequence
  sgRNA
  Susd2_20
ccaagagtcataagtaaaca

SEQ ID NO: 58902 - DNA, 20 bp, Artificial Sequence
  sgRNA
  Susd3_1
gcttcctgaagaccagtcaa

SEQ ID NO: 58903 - DNA, 20 bp, Artificial Sequence
  sgRNA
  Susd3_2
agtgtgtgcagaaaaatgag

SEQ ID NO: 58904 - DNA, 20 bp, Artificial Sequence
  sgRNA
  Susd3_3
ttaaagccgaaggtctcatg

SEQ ID NO: 58905 - DNA, 20 bp, Artificial Sequence
  sgRNA
  Susd3_4
atctccacggacgacttgca

SEQ ID NO: 58906 - DNA, 20 bp, Artificial Sequence
  sgRNA
  Susd3_5
tccacgcgttgaactctgca

SEQ ID NO: 58907 - DNA, 20 bp, Artificial Sequence
  sgRNA
  Susd3_6
acatcttgtcaggtaccctg

SEQ ID NO: 58908 - DNA, 20 bp, Artificial Sequence
  sgRNA
  Susd3_7
gccctgcagagttcaacgcg

SEQ ID NO: 58909 - DNA, 20 bp, Artificial Sequence
  sgRNA
  Susd3_8
ccagagatgtgccatctcca

SEQ ID NO: 58910 - DNA, 20 bp, Artificial Sequence
  sgRNA
  Susd3_9
gtgttcccagcacgccaccg

SEQ ID NO: 58911 - DNA, 20 bp, Artificial Sequence
  sgRNA
  Susd3_10
caacgcgtggaccatcacgt

SEQ ID NO: 58912 - DNA, 20 bp, Artificial Sequence
  sgRNA
  Susd3_11
gtgtgcagaaaaatgagcgg

SEQ ID NO: 58913 - DNA, 20 bp, Artificial Sequence
  sgRNA
  Susd3_12
gcttgccgccaccaccactg

SEQ ID NO: 58914 - DNA, 20 bp, Artificial Sequence
  sgRNA
  Susd3_13
ggcaccttgcaagtcgtccg

SEQ ID NO: 58915 - DNA, 20 bp, Artificial Sequence
  sgRNA
  Susd3_14
ggtgaagctgtggttgtcat

SEQ ID NO: 58916 - DNA, 20 bp, Artificial Sequence
  sgRNA
  Susd3_15
cggcgtgctgacaggtacag

SEQ ID NO: 58917 - DNA, 20 bp, Artificial Sequence
  sgRNA
  Susd3_16
gtgccaccgcatgagacctt

SEQ ID NO: 58918 - DNA, 20 bp, Artificial Sequence
  sgRNA
  Susd3_17
tgatgagcaacctcacagcc

SEQ ID NO: 58919 - DNA, 20 bp, Artificial Sequence
  sgRNA
  Susd3_18
cctgctctctgatgtcacca

SEQ ID NO: 58920 - DNA, 20 bp, Artificial Sequence
  sgRNA
  Susd3_19
aagccgaaggtctcatgcgg

SEQ ID NO: 58921 - DNA, 20 bp, Artificial Sequence
  sgRNA
  Susd3_20
gatgatggcacagctcacaa

SEQ ID NO: 58922 - DNA, 20 bp, Artificial Sequence
  sgRNA
  Susd4_1
tatcccatgtcccatcgtca

SEQ ID NO: 58923 - DNA, 20 bp, Artificial Sequence
  sgRNA
  Susd4_2
cgaaacaagacgtacagaca

SEQ ID NO: 58924 - DNA, 20 bp, Artificial Sequence
  sgRNA
  Susd4_3
taaggttgtgtaagcactcg

SEQ ID NO: 58925 - DNA, 20 bp, Artificial Sequence
  sgRNA
  Susd4_4
cgaagaaaactcctccgctg

SEQ ID NO: 58926 - DNA, 20 bp, Artificial Sequence
  sgRNA
  Susd4_5
aatcgtgtcaggggtgtccg

SEQ ID NO: 58927 - DNA, 20 bp, Artificial Sequence
  sgRNA
  Susd4_6
gaacgccacgatcttccacg

SEQ ID NO: 58928 - DNA, 20 bp, Artificial Sequence
  sgRNA
  Susd4_7
aggcgatcacagttcccaca

SEQ ID NO: 58929 - DNA, 20 bp, Artificial Sequence
  sgRNA
  Susd4_8
tagactctggagcatctccg

SEQ ID NO: 58930 - DNA, 20 bp, Artificial Sequence
  sgRNA
  Susd4_9
agaactccaccacagttcca

SEQ ID NO: 58931 - DNA, 20 bp, Artificial Sequence
  sgRNA
  Susd4_10
catccacgaccacaaagtcg

SEQ ID NO: 58932 - DNA, 20 bp, Artificial Sequence
  sgRNA
  Susd4_11
tctccgtgacttaccatagg

SEQ ID NO: 58933 - DNA, 20 bp, Artificial Sequence
  sgRNA
  Susd4_12
gtttcgttatgccgtgacga

SEQ ID NO: 58934 - DNA, 20 bp, Artificial Sequence
  sgRNA
  Susd4_13
catggaatgaacccgagcaa

SEQ ID NO: 58935 - DNA, 20 bp, Artificial Sequence
  sgRNA
  Susd4_14
ttccctggatttaaactcga

SEQ ID NO: 58936 - DNA, 20 bp, Artificial Sequence
  sgRNA
  Susd4_15
cgtcacggcataacgaaacc

SEQ ID NO: 58937 - DNA, 20 bp, Artificial Sequence
  sgRNA
  Susd4_16
tagtcattgactgtcacgag

SEQ ID NO: 58938 - DNA, 20 bp, Artificial Sequence
  sgRNA
  Susd4_17
ctaccctgacctgtacaacc

SEQ ID NO: 58939 - DNA, 20 bp, Artificial Sequence
  sgRNA
  Susd4_18
gttagtcattgactgtcacg

SEQ ID NO: 58940 - DNA, 20 bp, Artificial Sequence
  sgRNA
  Susd4_19
acctatgatgaggctgtgaa

SEQ ID NO: 58941 - DNA, 20 bp, Artificial Sequence
  sgRNA
  Susd4_20
agacctctagcctcttccaa

SEQ ID NO: 58942 - DNA, 20 bp, Artificial Sequence
  sgRNA
  Susd5_1
agagcattgtacttagcacc

SEQ ID NO: 58943 - DNA, 20 bp, Artificial Sequence
  sgRNA
  Susd5_2
aagtctcggccggaaaccag

SEQ ID NO: 58944 - DNA, 20 bp, Artificial Sequence
  sgRNA
  Susd5_3
atgacacggatctgtcatca

SEQ ID NO: 58945 - DNA, 20 bp, Artificial Sequence
  sgRNA
  Susd5_4
tcagtgggaccggatgaaag

SEQ ID NO: 58946 - DNA, 20 bp, Artificial Sequence
  sgRNA
  Susd5_5
gttctcaatcaaccataccc

SEQ ID NO: 58947 - DNA, 20 bp, Artificial Sequence
  sgRNA
  Susd5_6
ggacgaccgtgtgtagcaaa

SEQ ID NO: 58948 - DNA, 20 bp, Artificial Sequence
  sgRNA
  Susd5_7
acgtttatgtgtcggctgga

SEQ ID NO: 58949 - DNA, 20 bp, Artificial Sequence
  sgRNA
  Susd5_8
gactgagagttcccatacca

SEQ ID NO: 58950 - DNA, 20 bp, Artificial Sequence
  sgRNA
  Susd5_9
gctgttgcacaacaaggtaa

SEQ ID NO: 58951 - DNA, 20 bp, Artificial Sequence
  sgRNA
  Susd5_10
gtggcctccacatcagtcga

SEQ ID NO: 58952 - DNA, 20 bp, Artificial Sequence
  sgRNA
  Susd5_11
accactccctttgctacaca

SEQ ID NO: 58953 - DNA, 20 bp, Artificial Sequence
  sgRNA
  Susd5_12
actgctactcctggtagtcg

SEQ ID NO: 58954 - DNA, 20 bp, Artificial Sequence
  sgRNA
  Susd5_13
gagtagcagtagacacagga

SEQ ID NO: 58955 - DNA, 20 bp, Artificial Sequence
  sgRNA
  Susd5_14
aacctcggcaccgtgtgtag

SEQ ID NO: 58956 - DNA, 20 bp, Artificial Sequence
  sgRNA
  Susd5_15
ggtggagctggccagttcat

SEQ ID NO: 58957 - DNA, 20 bp, Artificial Sequence
  sgRNA
  Susd5_16
tcactgtgattgtctctggc

SEQ ID NO: 58958 - DNA, 20 bp, Artificial Sequence
  sgRNA
  Susd5_17
tcatggggtgaggtgacctt

SEQ ID NO: 58959 - DNA, 20 bp, Artificial Sequence
  sgRNA
  Susd5_18
acaagctgaacgttgggcag

SEQ ID NO: 58960 - DNA, 20 bp, Artificial Sequence
  sgRNA
  Susd5_19
ggctgtgtggtgactctccg

SEQ ID NO: 58961 - DNA, 20 bp, Artificial Sequence
  sgRNA
  Susd5_20
ggtggcctccacatcagtcg

SEQ ID NO: 58962 - DNA, 20 bp, Artificial Sequence
  sgRNA
  Sv2a_1
gcggtaatagccgtccgcag

SEQ ID NO: 58963 - DNA, 20 bp, Artificial Sequence
  sgRNA
  Sv2a_2
tgtggacactcacccgaccc

SEQ ID NO: 58964 - DNA, 20 bp, Artificial Sequence
  sgRNA
  Sv2a_3
tgagaaagacatgtgcctgt

SEQ ID NO: 58965 - DNA, 20 bp, Artificial Sequence
  sgRNA
  Sv2a_4
agccccgatggcaaacacag

SEQ ID NO: 58966 - DNA, 20 bp, Artificial Sequence
  sgRNA
  Sv2a_5
cctgcggacggctattaccg

SEQ ID NO: 58967 - DNA, 20 bp, Artificial Sequence
  sgRNA
  Sv2a_6
cttctgccgcctcctttccg

SEQ ID NO: 58968 - DNA, 20 bp, Artificial Sequence
  sgRNA
  Sv2a_7
agaatatcagggcatccccc

SEQ ID NO: 58969 - DNA, 20 bp, Artificial Sequence
  sgRNA
  Sv2a_8
gcttctagtgatgccaccga

SEQ ID NO: 58970 - DNA, 20 bp, Artificial Sequence
  sgRNA
  Sv2a_9
gcacgaagtagagtgtccac

SEQ ID NO: 58971 - DNA, 20 bp, Artificial Sequence
  sgRNA
  Sv2a_10
tgtatgttctggatgatcgg

SEQ ID NO: 58972 - DNA, 20 bp, Artificial Sequence
  sgRNA
  Sv2a_11
ccgagcagcgttcatccgtg

SEQ ID NO: 58973 - DNA, 20 bp, Artificial Sequence
  sgRNA
  Sv2a_12
gctgcccgctagacgtgacg

SEQ ID NO: 58974 - DNA, 20 bp, Artificial Sequence
  sgRNA
  Sv2a_13
gctctgctcatggacaagat

SEQ ID NO: 58975 - DNA, 20 bp, Artificial Sequence
  sgRNA
  Sv2a_14
ggagaatcagatccaccgag

SEQ ID NO: 58976 - DNA, 20 bp, Artificial Sequence
  sgRNA
  Sv2a_15
gcagtatgaaaccatcctcc

SEQ ID NO: 58977 - DNA, 20 bp, Artificial Sequence
  sgRNA
  Sv2a_16
ggttccataaccctggacga

SEQ ID NO: 58978 - DNA, 20 bp, Artificial Sequence
  sgRNA
  Sv2a_17
ttgcccccagactctgcccg

SEQ ID NO: 58979 - DNA, 20 bp, Artificial Sequence
  sgRNA
  Sv2a_18
tggcaatgtctttggcccca

SEQ ID NO: 58980 - DNA, 20 bp, Artificial Sequence
  sgRNA
  Sv2a_19
ggaacgtgctgttcaccagc

SEQ ID NO: 58981 - DNA, 20 bp, Artificial Sequence
  sgRNA
  Sv2a_20
tccaggatgagtattcccga

SEQ ID NO: 58982 - DNA, 20 bp, Artificial Sequence
  sgRNA
  Sv2b_1
ttcttatcacgagagaaacg

SEQ ID NO: 58983 - DNA, 20 bp, Artificial Sequence
  sgRNA
  Sv2b_2
atacaaacatgagagctaag

SEQ ID NO: 58984 - DNA, 20 bp, Artificial Sequence
  sgRNA
  Sv2b_3
atagggctgatagtctacct

SEQ ID NO: 58985 - DNA, 20 bp, Artificial Sequence
  sgRNA
  Sv2b_4
ttgcagttactacggcctga

SEQ ID NO: 58986 - DNA, 20 bp, Artificial Sequence
  sgRNA
  Sv2b_5
ggaaatagcggatcatgtcg

SEQ ID NO: 58987 - DNA, 20 bp, Artificial Sequence
  sgRNA
  Sv2b_6
tgttacagaaggccatgacg

SEQ ID NO: 58988 - DNA, 20 bp, Artificial Sequence
  sgRNA
  Sv2b_7
ccaagaccatctgctctgga

SEQ ID NO: 58989 - DNA, 20 bp, Artificial Sequence
  sgRNA
  Sv2b_8
gtagaaggtggtcgattcga

SEQ ID NO: 58990 - DNA, 20 bp, Artificial Sequence
  sgRNA
  Sv2b_9
gtaggcaaaaacaattggca

SEQ ID NO: 58991 - DNA, 20 bp, Artificial Sequence
  sgRNA
  Sv2b_10
tggagcatcattccacacta

SEQ ID NO: 58992 - DNA, 20 bp, Artificial Sequence
  sgRNA
  Sv2b_11
tcgagtctctggcaatcgaa

SEQ ID NO: 58993 - DNA, 20 bp, Artificial Sequence
  sgRNA
  Sv2b_12
tgtcggggaaccacaccgtc

SEQ ID NO: 58994 - DNA, 20 bp, Artificial Sequence
  sgRNA
  Sv2b_13
agctgtatcccaccaaccag

SEQ ID NO: 58995 - DNA, 20 bp, Artificial Sequence
  sgRNA
  Sv2b_14
gcaagacagagaggctgccg

SEQ ID NO: 58996 - DNA, 20 bp, Artificial Sequence
  sgRNA
  Sv2b_15
tccaattctgtccatgagca

SEQ ID NO: 58997 - DNA, 20 bp, Artificial Sequence
  sgRNA
  Sv2b_16
tacggtagtagccatcacta

SEQ ID NO: 58998 - DNA, 20 bp, Artificial Sequence
  sgRNA
  Sv2b_17
tcactctcctccttcgtgca

SEQ ID NO: 58999 - DNA, 20 bp, Artificial Sequence
  sgRNA
  Sv2b_18
tccttcccagtttatcagcc

SEQ ID NO: 59000 - DNA, 20 bp, Artificial Sequence
  sgRNA
  Sv2b_19
aggcatctatgcatctgcca

SEQ ID NO: 59001 - DNA, 20 bp, Artificial Sequence
  sgRNA
  Sv2b_20
aacacaagttcatcaactgt

SEQ ID NO: 59002 - DNA, 20 bp, Artificial Sequence
  sgRNA
  Sv2c_1
atcccgaatttggtatgcat

SEQ ID NO: 59003 - DNA, 20 bp, Artificial Sequence
  sgRNA
  Sv2c_2
gaagtcaccttaccgtagtg

SEQ ID NO: 59004 - DNA, 20 bp, Artificial Sequence
  sgRNA
  Sv2c_3
tggcgaaacctacagtgggg

SEQ ID NO: 59005 - DNA, 20 bp, Artificial Sequence
  sgRNA
  Sv2c_4
gacaccaacatgagagcccg

SEQ ID NO: 59006 - DNA, 20 bp, Artificial Sequence
  sgRNA
  Sv2c_5
ggacggccgccgctttacag

SEQ ID NO: 59007 - DNA, 20 bp, Artificial Sequence
  sgRNA
  Sv2c_6
gaaccgactgtaggaccgct

SEQ ID NO: 59008 - DNA, 20 bp, Artificial Sequence
  sgRNA
  Sv2c_7
ataatccaagagtgtggcca

SEQ ID NO: 59009 - DNA, 20 bp, Artificial Sequence
  sgRNA
  Sv2c_8
ggtacaggaggtgtttcgtt

SEQ ID NO: 59010 - DNA, 20 bp, Artificial Sequence
  sgRNA
  Sv2c_9
gaacgccctctgtaaagcgg

SEQ ID NO: 59011 - DNA, 20 bp, Artificial Sequence
  sgRNA
  Sv2c_10
cctcggagtcaagttcaaat

SEQ ID NO: 59012 - DNA, 20 bp, Artificial Sequence
  sgRNA
  Sv2c_11
acgcccccaccatcatcccg

SEQ ID NO: 59013 - DNA, 20 bp, Artificial Sequence
  sgRNA
  Sv2c_12
gataggacttcactgatgaa

SEQ ID NO: 59014 - DNA, 20 bp, Artificial Sequence
  sgRNA
  Sv2c_13
gttgacaaagtaaatccagt

SEQ ID NO: 59015 - DNA, 20 bp, Artificial Sequence
  sgRNA
  Sv2c_14
ccttcatgccagaaagccct

SEQ ID NO: 59016 - DNA, 20 bp, Artificial Sequence
  sgRNA
  Sv2c_15
gccaccacagaggagacgca

SEQ ID NO: 59017 - DNA, 20 bp, Artificial Sequence
  sgRNA
  Sv2c_16
gggcccactggaaacggccg

SEQ ID NO: 59018 - DNA, 20 bp, Artificial Sequence
  sgRNA
  Sv2c_17
cggcatctacgcctccgcca

SEQ ID NO: 59019 - DNA, 20 bp, Artificial Sequence
  sgRNA
  Sv2c_18
ggcatccccagcacgaacca

SEQ ID NO: 59020 - DNA, 20 bp, Artificial Sequence
  sgRNA
  Sv2c_19
gtgtctgtaggacagcccaa

SEQ ID NO: 59021 - DNA, 20 bp, Artificial Sequence
  sgRNA
  Sv2c_20
aggaggatgagatctatgaa

SEQ ID NO: 59022 - DNA, 20 bp, Artificial Sequence
  sgRNA
  Svopl_1
agagaccaagacattcacgg

SEQ ID NO: 59023 - DNA, 20 bp, Artificial Sequence
  sgRNA
  Svopl_2
acttcaccttacctgcgaca

SEQ ID NO: 59024 - DNA, 20 bp, Artificial Sequence
  sgRNA
  Svopl_3
aaccgctcagtcatgccaga

SEQ ID NO: 59025 - DNA, 20 bp, Artificial Sequence
  sgRNA
  Svopl_4
ctcctgttatccgatgtgaa

SEQ ID NO: 59026 - DNA, 20 bp, Artificial Sequence
  sgRNA
  Svopl_5
gctgagcctgtcgatcacca

SEQ ID NO: 59027 - DNA, 20 bp, Artificial Sequence
  sgRNA
  Svopl_6
attgcactcttcctaatcat

SEQ ID NO: 59028 - DNA, 20 bp, Artificial Sequence
  sgRNA
  Svopl_7
gcgcgtcctttggtctcaat

SEQ ID NO: 59029 - DNA, 20 bp, Artificial Sequence
  sgRNA
  Svopl_8
tggtcatccccaccattggg

SEQ ID NO: 59030 - DNA, 20 bp, Artificial Sequence
  sgRNA
  Svopl_9
catccctatagcacgcatcg

SEQ ID NO: 59031 - DNA, 20 bp, Artificial Sequence
  sgRNA
  Svopl_10
cattgctccaatgcgacaca

SEQ ID NO: 59032 - DNA, 20 bp, Artificial Sequence
  sgRNA
  Svopl_11
caaccccgatgcgtgctata

SEQ ID NO: 59033 - DNA, 20 bp, Artificial Sequence
  sgRNA
  Svopl_12
ctcgcttcaacgtctccact

SEQ ID NO: 59034 - DNA, 20 bp, Artificial Sequence
  sgRNA
  Svopl_13
tgttgaagtttgctgccacc

SEQ ID NO: 59035 - DNA, 20 bp, Artificial Sequence
  sgRNA
  Svopl_14
gatgagccaacgccacccaa

SEQ ID NO: 59036 - DNA, 20 bp, Artificial Sequence
  sgRNA
  Svopl_15
ctgagcctgtcgatcaccat

SEQ ID NO: 59037 - DNA, 20 bp, Artificial Sequence
  sgRNA
  Svopl_16
gcaaatatgtggcaatagca

SEQ ID NO: 59038 - DNA, 20 bp, Artificial Sequence
  sgRNA
  Svopl_17
actcttcccattgagaccaa

SEQ ID NO: 59039 - DNA, 20 bp, Artificial Sequence
  sgRNA
  Svopl_18
ggccatgctgatgatgagca

SEQ ID NO: 59040 - DNA, 20 bp, Artificial Sequence
  sgRNA
  Svopl_19
ctgtggtcatccccaccatt

SEQ ID NO: 59041 - DNA, 20 bp, Artificial Sequence
  sgRNA
  Svopl_20
tctccagctgccattcacat

SEQ ID NO: 59042 - DNA, 20 bp, Artificial Sequence
  sgRNA
  Syna_1
gtcatcggggtatctcaccg

SEQ ID NO: 59043 - DNA, 20 bp, Artificial Sequence
  sgRNA
  Syna_2
ccaccctattaccctgtctg

SEQ ID NO: 59044 - DNA, 20 bp, Artificial Sequence
  sgRNA
  Syna_3
aggaagagttagcctcctgg

SEQ ID NO: 59045 - DNA, 20 bp, Artificial Sequence
  sgRNA
  Syna_4
cccactgttaagaaaaacgg

SEQ ID NO: 59046 - DNA, 20 bp, Artificial Sequence
  sgRNA
  Syna_5
cgaattgtccggctcgaata

SEQ ID NO: 59047 - DNA, 20 bp, Artificial Sequence
  sgRNA
  Syna_6
gcctgactcattctgtatcg

SEQ ID NO: 59048 - DNA, 20 bp, Artificial Sequence
  sgRNA
  Syna_7
gattgaatattgtccagaga

SEQ ID NO: 59049 - DNA, 20 bp, Artificial Sequence
  sgRNA
  Syna_8
gatcttgtccacgtgtcctt

SEQ ID NO: 59050 - DNA, 20 bp, Artificial Sequence
  sgRNA
  Syna_9
aagcaatgcccaggcccgcg

SEQ ID NO: 59051 - DNA, 20 bp, Artificial Sequence
  sgRNA
  Syna_10
agaccaaatagactcgctgg

SEQ ID NO: 59052 - DNA, 20 bp, Artificial Sequence
  sgRNA
  Syna_11
gaggtgatccgagaaagtat

SEQ ID NO: 59053 - DNA, 20 bp, Artificial Sequence
  sgRNA
  Syna_12
gaccaaatagactcgctggc

SEQ ID NO: 59054 - DNA, 20 bp, Artificial Sequence
  sgRNA
  Syna_13
gccgcgatacagaatgagtc

SEQ ID NO: 59055 - DNA, 20 bp, Artificial Sequence
  sgRNA
  Syna_14
gtatttccaacagctttcca

SEQ ID NO: 59056 - DNA, 20 bp, Artificial Sequence
  sgRNA
  Syna_15
cgagcttgtgccgagttccg

SEQ ID NO: 59057 - DNA, 20 bp, Artificial Sequence
  sgRNA
  Syna_16
gttcttggatccagtggctg

SEQ ID NO: 59058 - DNA, 20 bp, Artificial Sequence
  sgRNA
  Syna_17
ggtgatctgaaggaaagcaa

SEQ ID NO: 59059 - DNA, 20 bp, Artificial Sequence
  sgRNA
  Syna_18
ccccattaatggccatgcca

SEQ ID NO: 59060 - DNA, 20 bp, Artificial Sequence
  sgRNA
  Syna_19
gggggtcctgaaaagcgtaa

SEQ ID NO: 59061 - DNA, 20 bp, Artificial Sequence
  sgRNA
  Syna_20
gtcaaccaagagggcagcca

SEQ ID NO: 59062 - DNA, 20 bp, Artificial Sequence
  sgRNA
  Synb_1
tgcctgtttgaacgtatggg

SEQ ID NO: 59063 - DNA, 20 bp, Artificial Sequence
  sgRNA
  Synb_2
agcacggtctcagtaaagag

SEQ ID NO: 59064 - DNA, 20 bp, Artificial Sequence
  sgRNA
  Synb_3
gggaagagttggtatcacgt

SEQ ID NO: 59065 - DNA, 20 bp, Artificial Sequence
  sgRNA
  Synb_4
aagaataggaggcagtcagt

SEQ ID NO: 59066 - DNA, 20 bp, Artificial Sequence
  sgRNA
  Synpr_1
aagtaccgcgaaaacaaccg

SEQ ID NO: 59067 - DNA, 20 bp, Artificial Sequence
  sgRNA
  Synpr_2
ggtgacaaagaattctgctg

SEQ ID NO: 59068 - DNA, 20 bp, Artificial Sequence
  sgRNA
  Synpr_3
gcagccttccaacaagtgca

SEQ ID NO: 59069 - DNA, 20 bp, Artificial Sequence
  sgRNA
  Synpr_4
ctcacaggtgggcacttcaa

SEQ ID NO: 59070 - DNA, 20 bp, Artificial Sequence
  sgRNA
  Synpr_5
gagatacctttcagacccca

SEQ ID NO: 59071 - DNA, 20 bp, Artificial Sequence
  sgRNA
  Synpr_6
aggctgttggccaaactcat

SEQ ID NO: 59072 - DNA, 20 bp, Artificial Sequence
  sgRNA
  Synpr_7
ggaacagcagaagctggcat

SEQ ID NO: 59073 - DNA, 20 bp, Artificial Sequence
  sgRNA
  Synpr_8
acaagtaccgcgaaaacaac

SEQ ID NO: 59074 - DNA, 20 bp, Artificial Sequence
  sgRNA
  Synpr_9
gagaaaggcgaacacagcca

SEQ ID NO: 59075 - DNA, 20 bp, Artificial Sequence
  sgRNA
  Synpr_10
acatgtggtggctattcagg

SEQ ID NO: 59076 - DNA, 20 bp, Artificial Sequence
  sgRNA
  Synpr_11
gagtttggccaacagcctag

SEQ ID NO: 59077 - DNA, 20 bp, Artificial Sequence
  sgRNA
  Synpr_12
accaaatgtttccagcccag

SEQ ID NO: 59078 - DNA, 20 bp, Artificial Sequence
  sgRNA
  Synpr_13
tgaaaggtatctctgtccag

SEQ ID NO: 59079 - DNA, 20 bp, Artificial Sequence
  sgRNA
  Synpr_14
agagttatgggtcaagtggt

SEQ ID NO: 59080 - DNA, 20 bp, Artificial Sequence
  sgRNA
  Synpr_15
acagccagcaggcgaatctg

SEQ ID NO: 59081 - DNA, 20 bp, Artificial Sequence
  sgRNA
  Synpr_16
aaaagcatggaaaaatgcag

SEQ ID NO: 59082 - DNA, 20 bp, Artificial Sequence
  sgRNA
  Synpr_17
caaacgctatgtcaatgctg

SEQ ID NO: 59083 - DNA, 20 bp, Artificial Sequence
  sgRNA
  Synpr_18
gcttctccatggggtctgaa

SEQ ID NO: 59084 - DNA, 20 bp, Artificial Sequence
  sgRNA
  Synpr_19
ttaaaggaagtgggaccact

SEQ ID NO: 59085 - DNA, 20 bp, Artificial Sequence
  sgRNA
  Synpr_20
gtacacgaccgtggcagcca

SEQ ID NO: 59086 - DNA, 20 bp, Artificial Sequence
  sgRNA
  Syp_1
gcaccctcctgcgttaaagg

SEQ ID NO: 59087 - DNA, 20 bp, Artificial Sequence
  sgRNA
  Syp_2
gtagctgccgcacgtagcaa

SEQ ID NO: 59088 - DNA, 20 bp, Artificial Sequence
  sgRNA
  Syp_3
caaattcgacttcgatgttg

SEQ ID NO: 59089 - DNA, 20 bp, Artificial Sequence
  sgRNA
  Syp_4
aagtaccgagagaacaacaa

SEQ ID NO: 59090 - DNA, 20 bp, Artificial Sequence
  sgRNA
  Syp_5
aggtacgcgctccagcaccg

SEQ ID NO: 59091 - DNA, 20 bp, Artificial Sequence
  sgRNA
  Syp_6
ataaccaccctgaggcccgt

SEQ ID NO: 59092 - DNA, 20 bp, Artificial Sequence
  sgRNA
  Syp_7
gcatcgccgtaggcatcgcc

SEQ ID NO: 59093 - DNA, 20 bp, Artificial Sequence
  sgRNA
  Syp_8
ggtagtgccccctttaacgc

SEQ ID NO: 59094 - DNA, 20 bp, Artificial Sequence
  sgRNA
  Syp_9
gctacgtgcggcagctacac

SEQ ID NO: 59095 - DNA, 20 bp, Artificial Sequence
  sgRNA
  Syp_10
gcagcaccttcacgaagcca

SEQ ID NO: 59096 - DNA, 20 bp, Artificial Sequence
  sgRNA
  Syp_11
gtgccccctttaacgcagga

SEQ ID NO: 59097 - DNA, 20 bp, Artificial Sequence
  sgRNA
  Syp_12
tctccttgaacacgaaccat

SEQ ID NO: 59098 - DNA, 20 bp, Artificial Sequence
  sgRNA
  Syp_13
agtaccgagagaacaacaaa

SEQ ID NO: 59099 - DNA, 20 bp, Artificial Sequence
  sgRNA
  Syp_14
ggtgacaaagaattcagccg

SEQ ID NO: 59100 - DNA, 20 bp, Artificial Sequence
  sgRNA
  Syp_15
ggacaggcctttggcccagg

SEQ ID NO: 59101 - DNA, 20 bp, Artificial Sequence
  sgRNA
  Syp_16
tttcctgtctggcggcacat

SEQ ID NO: 59102 - DNA, 20 bp, Artificial Sequence
  sgRNA
  Syp_17
tgctgcccatagtcgccctg

SEQ ID NO: 59103 - DNA, 20 bp, Artificial Sequence
  sgRNA
  Syp_18
ggctagttagctcatccgcc

SEQ ID NO: 59104 - DNA, 20 bp, Artificial Sequence
  sgRNA
  Syp_19
ggagccccttggcttcgtga

SEQ ID NO: 59105 - DNA, 20 bp, Artificial Sequence
  sgRNA
  Syp_20
caccacctctcagggttcga

SEQ ID NO: 59106 - DNA, 20 bp, Artificial Sequence
  sgRNA
  Sypl_1
aagctgcactcacccactcg

SEQ ID NO: 59107 - DNA, 20 bp, Artificial Sequence
  sgRNA
  Sypl_2
aaacggttacttacgatcat

SEQ ID NO: 59108 - DNA, 20 bp, Artificial Sequence
  sgRNA
  Sypl_3
tggaaggcggacatcctctg

SEQ ID NO: 59109 - DNA, 20 bp, Artificial Sequence
  sgRNA
  Sypl_4
aacgtagaactgtgcagaag

SEQ ID NO: 59110 - DNA, 20 bp, Artificial Sequence
  sgRNA
  Sypl_5
aggatcttgatgaagccgag

SEQ ID NO: 59111 - DNA, 20 bp, Artificial Sequence
  sgRNA
  Sypl_6
aagccaacatggttcgtcag

SEQ ID NO: 59112 - DNA, 20 bp, Artificial Sequence
  sgRNA
  Sypl_7
aacccgctcaaggagccgct

SEQ ID NO: 59113 - DNA, 20 bp, Artificial Sequence
  sgRNA
  Sypl_8
tggttacacgaacctctacc

SEQ ID NO: 59114 - DNA, 20 bp, Artificial Sequence
  sgRNA
  Sypl_9
tggttcgtcagcggttcagc

SEQ ID NO: 59115 - DNA, 20 bp, Artificial Sequence
  sgRNA
  Sypl_10
gttgaggttgatctggaagg

SEQ ID NO: 59116 - DNA, 20 bp, Artificial Sequence
  sgRNA
  Sypl_11
gcttcccacagccaaggcgg

SEQ ID NO: 59117 - DNA, 20 bp, Artificial Sequence
  sgRNA
  Sypl_12
ctgaatatgatactttgggg

SEQ ID NO: 59118 - DNA, 20 bp, Artificial Sequence
  sgRNA
  Sypl_13
ggtggcaaaagcaaagatgg

SEQ ID NO: 59119 - DNA, 20 bp, Artificial Sequence
  sgRNA
  Sypl_14
gttggtgagttcctcagcct

SEQ ID NO: 59120 - DNA, 20 bp, Artificial Sequence
  sgRNA
  Sypl_15
tactggacacagaattgtgg

SEQ ID NO: 59121 - DNA, 20 bp, Artificial Sequence
  sgRNA
  Sypl_16
atctgtaagagctttagccc

SEQ ID NO: 59122 - DNA, 20 bp, Artificial Sequence
  sgRNA
  Sypl_17
aagccgagcggctccttgag

SEQ ID NO: 59123 - DNA, 20 bp, Artificial Sequence
  sgRNA
  Sypl_18
ctgacgaaccatgttggctt

SEQ ID NO: 59124 - DNA, 20 bp, Artificial Sequence
  sgRNA
  Sypl_19
tgggaagctgacgtatttga

SEQ ID NO: 59125 - DNA, 20 bp, Artificial Sequence
  sgRNA
  Sypl_20
tcacacacactgacatttgg

SEQ ID NO: 59126 - DNA, 20 bp, Artificial Sequence
  sgRNA
  Taar1_1
caggaaggctccaactaacg

SEQ ID NO: 59127 - DNA, 20 bp, Artificial Sequence
  sgRNA
  Taar1_2
tgagaactgttgagcgctgt

SEQ ID NO: 59128 - DNA, 20 bp, Artificial Sequence
  sgRNA
  Taar1_3
gcccagcagaaagtcgacaa

SEQ ID NO: 59129 - DNA, 20 bp, Artificial Sequence
  sgRNA
  Taar1_4
gagtgacattaagctgtaca

SEQ ID NO: 59130 - DNA, 20 bp, Artificial Sequence
  sgRNA
  Taar1_5
ccagatactttactaaagaa

SEQ ID NO: 59131 - DNA, 20 bp, Artificial Sequence
  sgRNA
  Taar1_6
catgatccctaaggtcttcg

SEQ ID NO: 59132 - DNA, 20 bp, Artificial Sequence
  sgRNA
  Taar1_7
aagaccttagggatcatggt

SEQ ID NO: 59133 - DNA, 20 bp, Artificial Sequence
  sgRNA
  Taar1_8
agtcaggtcagcgacctggg

SEQ ID NO: 59134 - DNA, 20 bp, Artificial Sequence
  sgRNA
  Taar1_9
gaattctgccctcaatccga

SEQ ID NO: 59135 - DNA, 20 bp, Artificial Sequence
  sgRNA
  Taar1_10
tgctggtgtgaactttacag

SEQ ID NO: 59136 - DNA, 20 bp, Artificial Sequence
  sgRNA
  Taar1_11
gccattgtcgactttctgct

SEQ ID NO: 59137 - DNA, 20 bp, Artificial Sequence
  sgRNA
  Taar1_12
tcatagctaaaggacaagca

SEQ ID NO: 59138 - DNA, 20 bp, Artificial Sequence
  sgRNA
  Taar1_13
cagaaagtcgacaatggcca

SEQ ID NO: 59139 - DNA, 20 bp, Artificial Sequence
  sgRNA
  Taar1_14
ggcggagctcagcatgatat

SEQ ID NO: 59140 - DNA, 20 bp, Artificial Sequence
  sgRNA
  Taar1_15
acagttctcaccatgctgca

SEQ ID NO: 59141 - DNA, 20 bp, Artificial Sequence
  sgRNA
  Taar1_16
ttcaaggctcttctgaacca

SEQ ID NO: 59142 - DNA, 20 bp, Artificial Sequence
  sgRNA
  Taar1_17
tacagtgcgtcattcagaga

SEQ ID NO: 59143 - DNA, 20 bp, Artificial Sequence
  sgRNA
  Taar1_18
ggaactgaacttaaaaggag

SEQ ID NO: 59144 - DNA, 20 bp, Artificial Sequence
  sgRNA
  Taar1_19
tttcccacagaaacagcgac

SEQ ID NO: 59145 - DNA, 20 bp, Artificial Sequence
  sgRNA
  Taar1_20
tgaccagtcgctgtttctgt

SEQ ID NO: 59146 - DNA, 20 bp, Artificial Sequence
  sgRNA
  Taar2_1
tgactatcccggtcgttagg

SEQ ID NO: 59147 - DNA, 20 bp, Artificial Sequence
  sgRNA
  Taar2_2
gatcgtgatgaatatggcgc

SEQ ID NO: 59148 - DNA, 20 bp, Artificial Sequence
  sgRNA
  Taar2_3
tcatgttcaacaagctatgg

SEQ ID NO: 59149 - DNA, 20 bp, Artificial Sequence
  sgRNA
  Taar2_4
tatcgacggccaccgagcaa

SEQ ID NO: 59150 - DNA, 20 bp, Artificial Sequence
  sgRNA
  Taar2_5
ccccaaaggcaaacgccccg

SEQ ID NO: 59151 - DNA, 20 bp, Artificial Sequence
  sgRNA
  Taar2_6
tccgtactctgaacaatcaa

SEQ ID NO: 59152 - DNA, 20 bp, Artificial Sequence
  sgRNA
  Taar2_7
gatggcataaaatctatcga

SEQ ID NO: 59153 - DNA, 20 bp, Artificial Sequence
  sgRNA
  Taar2_8
atagcttgttgaacatgact

SEQ ID NO: 59154 - DNA, 20 bp, Artificial Sequence
  sgRNA
  Taar2_9
cgtctgctggtcagtccccg

SEQ ID NO: 59155 - DNA, 20 bp, Artificial Sequence
  sgRNA
  Taar2_10
aattcagaaacggatctaac

SEQ ID NO: 59156 - DNA, 20 bp, Artificial Sequence
  sgRNA
  Taar2_11
gattgttcagagtacggaaa

SEQ ID NO: 59157 - DNA, 20 bp, Artificial Sequence
  sgRNA
  Taar2_12
actgacctgaccatactata

SEQ ID NO: 59158 - DNA, 20 bp, Artificial Sequence
  sgRNA
  Taar2_13
agcagcagccgcctaacgac

SEQ ID NO: 59159 - DNA, 20 bp, Artificial Sequence
  sgRNA
  Taar2_14
actcctagctcgatgatggt

SEQ ID NO: 59160 - DNA, 20 bp, Artificial Sequence
  sgRNA
  Taar2_15
tgagtgctctgcgaaaccaa

SEQ ID NO: 59161 - DNA, 20 bp, Artificial Sequence
  sgRNA
  Taar2_16
gcatgatggtgaatccgaga

SEQ ID NO: 59162 - DNA, 20 bp, Artificial Sequence
  sgRNA
  Taar2_17
gtcatgttcaacaagctatg

SEQ ID NO: 59163 - DNA, 20 bp, Artificial Sequence
  sgRNA
  Taar2_18
gcaggccatcaacgagtaca

SEQ ID NO: 59164 - DNA, 20 bp, Artificial Sequence
  sgRNA
  Taar2_19
tcaacgagtacatggcagct

SEQ ID NO: 59165 - DNA, 20 bp, Artificial Sequence
  sgRNA
  Taar2_20
tttgatgccttaacatggtt

SEQ ID NO: 59166 - DNA, 20 bp, Artificial Sequence
  sgRNA
  Taar5_1
gacagccctccgctacatcg

SEQ ID NO: 59167 - DNA, 20 bp, Artificial Sequence
  sgRNA
  Taar5_2
aggccagatagatgacgacc

SEQ ID NO: 59168 - DNA, 20 bp, Artificial Sequence
  sgRNA
  Taar5_3
cgtgtggagcactttaaagt

SEQ ID NO: 59169 - DNA, 20 bp, Artificial Sequence
  sgRNA
  Taar5_4
aagctgatcatgattaggca

SEQ ID NO: 59170 - DNA, 20 bp, Artificial Sequence
  sgRNA
  Taar5_5
ccctgccacgatgtagcgga

SEQ ID NO: 59171 - DNA, 20 bp, Artificial Sequence
  sgRNA
  Taar5_6
actagtgtgtcaacagtgaa

SEQ ID NO: 59172 - DNA, 20 bp, Artificial Sequence
  sgRNA
  Taar5_7
tcatctacgtcttctcctac

SEQ ID NO: 59173 - DNA, 20 bp, Artificial Sequence
  sgRNA
  Taar5_8
agatctttgtggtcgccacc

SEQ ID NO: 59174 - DNA, 20 bp, Artificial Sequence
  sgRNA
  Taar5_9
tgccttcctaaaccaccggt

SEQ ID NO: 59175 - DNA, 20 bp, Artificial Sequence
  sgRNA
  Taar5_10
gcttggctggggctgtcaag

SEQ ID NO: 59176 - DNA, 20 bp, Artificial Sequence
  sgRNA
  Taar5_11
gatctgctgagcctgcctgg

SEQ ID NO: 59177 - DNA, 20 bp, Artificial Sequence
  sgRNA
  Taar5_12
tcagtgccttcctaaaccac

SEQ ID NO: 59178 - DNA, 20 bp, Artificial Sequence
  sgRNA
  Taar5_13
ggcagggaacaaaaaatgca

SEQ ID NO: 59179 - DNA, 20 bp, Artificial Sequence
  sgRNA
  Taar5_14
gctgctctccagagcccggg

SEQ ID NO: 59180 - DNA, 20 bp, Artificial Sequence
  sgRNA
  Taar5_15
gatggcacaatgacggtcaa

SEQ ID NO: 59181 - DNA, 20 bp, Artificial Sequence
  sgRNA
  Taar5_16
cccaccctgccacgatgtag

SEQ ID NO: 59182 - DNA, 20 bp, Artificial Sequence
  sgRNA
  Taar5_17
gtaggagaagacgtagatga

SEQ ID NO: 59183 - DNA, 20 bp, Artificial Sequence
  sgRNA
  Taar5_18
ataaagatgtcaaagaccag

SEQ ID NO: 59184 - DNA, 20 bp, Artificial Sequence
  sgRNA
  Taar5_19
atgacgacctggatggccag

SEQ ID NO: 59185 - DNA, 20 bp, Artificial Sequence
  sgRNA
  Taar5_20
gaacttggagggatagagca

SEQ ID NO: 59186 - DNA, 20 bp, Artificial Sequence
  sgRNA
  Taar8a_1
actgcactgctgtacaccag

SEQ ID NO: 59187 - DNA, 20 bp, Artificial Sequence
  sgRNA
  Taar8a_2
tgtccactgagatgaagcag

SEQ ID NO: 59188 - DNA, 20 bp, Artificial Sequence
  sgRNA
  Taar8a_3
agtgctctaaattgtgtagg

SEQ ID NO: 59189 - DNA, 20 bp, Artificial Sequence
  sgRNA
  Taar8a_4
accatgtacaggatgacccg

SEQ ID NO: 59190 - DNA, 20 bp, Artificial Sequence
  sgRNA
  Taar8a_5
ccacctctgcttcatctcag

SEQ ID NO: 59191 - DNA, 20 bp, Artificial Sequence
  sgRNA
  Taar8a_6
ttaagtggggaaattctaaa

SEQ ID NO: 59192 - DNA, 20 bp, Artificial Sequence
  sgRNA
  Taar8a_7
gtaagtgctctaaattgtgt

SEQ ID NO: 59193 - DNA, 20 bp, Artificial Sequence
  sgRNA
  Taar8a_8
tttatggctttcttaaacca

SEQ ID NO: 59194 - DNA, 20 bp, Artificial Sequence
  sgRNA
  Taar8a_9
cactgcactgctgtacacca

SEQ ID NO: 59195 - DNA, 20 bp, Artificial Sequence
  sgRNA
  Taar8a_10
aagtgctctaaattgtgtag

SEQ ID NO: 59196 - DNA, 20 bp, Artificial Sequence
  sgRNA
  Taar8a_11
ccaatgcgtcaattgtgtat

SEQ ID NO: 59197 - DNA, 20 bp, Artificial Sequence
  sgRNA
  Taar8a_12
ggacaggtacatcgctgtca

SEQ ID NO: 59198 - DNA, 20 bp, Artificial Sequence
  sgRNA
  Taar8a_13
tctgcttcatctcagtggac

SEQ ID NO: 59199 - DNA, 20 bp, Artificial Sequence
  sgRNA
  Taar8a_14
ctgagatgaagcagaggtgg

SEQ ID NO: 59200 - DNA, 20 bp, Artificial Sequence
  sgRNA
  Taar8a_15
tgtctatgaaatctgttgct

SEQ ID NO: 59201 - DNA, 20 bp, Artificial Sequence
  sgRNA
  Taar8a_16
ccactgagatgaagcagagg

SEQ ID NO: 59202 - DNA, 20 bp, Artificial Sequence
  sgRNA
  Taar8a_17
taagtgctctaaattgtgta

SEQ ID NO: 59203 - DNA, 20 bp, Artificial Sequence
  sgRNA
  Taar8a_18
accaatgcgtcaattgtgta

SEQ ID NO: 59204 - DNA, 20 bp, Artificial Sequence
  sgRNA
  Taar8a_19
agtcttgattgataacaatt

SEQ ID NO: 59205 - DNA, 20 bp, Artificial Sequence
  sgRNA
  Taar8a_20
ccacatcacaacaactgtga

SEQ ID NO: 59206 - DNA, 20 bp, Artificial Sequence
  sgRNA
  Taar8b_1
aatcgttgtcaatcaagact

SEQ ID NO: 59207 - DNA, 20 bp, Artificial Sequence
  sgRNA
  Taar8b_2
tgtccactgagatgaagcac

SEQ ID NO: 59208 - DNA, 20 bp, Artificial Sequence
  sgRNA
  Taar8b_3
agcagtgcagtgttctacac

SEQ ID NO: 59209 - DNA, 20 bp, Artificial Sequence
  sgRNA
  Taar8b_4
gaagtcagcgctggccagag

SEQ ID NO: 59210 - DNA, 20 bp, Artificial Sequence
  sgRNA
  Taar8b_5
acttctgtaagtgacaacag

SEQ ID NO: 59211 - DNA, 20 bp, Artificial Sequence
  sgRNA
  Taar8b_6
gccagcgctgacttcttggt

SEQ ID NO: 59212 - DNA, 20 bp, Artificial Sequence
  sgRNA
  Taar8b_7
tcattggttgatgctttcgt

SEQ ID NO: 59213 - DNA, 20 bp, Artificial Sequence
  sgRNA
  Taar8b_8
caaagccaaagaccatgtac

SEQ ID NO: 59214 - DNA, 20 bp, Artificial Sequence
  sgRNA
  Taar8b_9
agtcttgattgacaacgatt

SEQ ID NO: 59215 - DNA, 20 bp, Artificial Sequence
  sgRNA
  Taar8b_10
gtacatggtctttggctttg

SEQ ID NO: 59216 - DNA, 20 bp, Artificial Sequence
  sgRNA
  Taar8b_11
ccaatgagtcaattgtgtat

SEQ ID NO: 59217 - DNA, 20 bp, Artificial Sequence
  sgRNA
  Taar8b_12
accaatgagtcaattgtgta

SEQ ID NO: 59218 - DNA, 20 bp, Artificial Sequence
  sgRNA
  Taar8b_13
ggccagcgctgacttcttgg

SEQ ID NO: 59219 - DNA, 20 bp, Artificial Sequence
  sgRNA
  Taar8b_14
gcccaccaagaagtcagcgc

SEQ ID NO: 59220 - DNA, 20 bp, Artificial Sequence
  sgRNA
  Taar8b_15
cccatacacaattgactcat

SEQ ID NO: 59221 - DNA, 20 bp, Artificial Sequence
  sgRNA
  Taar8b_16
cattgctgtcacagaccctc

SEQ ID NO: 59222 - DNA, 20 bp, Artificial Sequence
  sgRNA
  Taar8b_17
ctgtacatggtctttggctt

SEQ ID NO: 59223 - DNA, 20 bp, Artificial Sequence
  sgRNA
  Taar8b_18
aaatcgttgtcaatcaagac

SEQ ID NO: 59224 - DNA, 20 bp, Artificial Sequence
  sgRNA
  Taar8b_19
gtcatcctgtacatggtctt

SEQ ID NO: 59225 - DNA, 20 bp, Artificial Sequence
  sgRNA
  Taar8b_20
tgtacatggtctttggcttt

SEQ ID NO: 59226 - DNA, 20 bp, Artificial Sequence
  sgRNA
  Taar8c_1
actgcactgctgtataccag

SEQ ID NO: 59227 - DNA, 20 bp, Artificial Sequence
  sgRNA
  Taar8c_2
ggacaggtacatagctgtca

SEQ ID NO: 59228 - DNA, 20 bp, Artificial Sequence
  sgRNA
  Taar8c_3
agtgctctgaattgtgtagg

SEQ ID NO: 59229 - DNA, 20 bp, Artificial Sequence
  sgRNA
  Taar8c_4
agaatgatcataacaacggt

SEQ ID NO: 59230 - DNA, 20 bp, Artificial Sequence
  sgRNA
  Taar8c_5
ttaagtgggaaaattctaaa

SEQ ID NO: 59231 - DNA, 20 bp, Artificial Sequence
  sgRNA
  Taar8c_6
agtcttgattgacaacaact

SEQ ID NO: 59232 - DNA, 20 bp, Artificial Sequence
  sgRNA
  Taar8c_7
agttgttgtcaatcaagact

SEQ ID NO: 59233 - DNA, 20 bp, Artificial Sequence
  sgRNA
  Taar8c_8
accaatgcatcaattgtgta

SEQ ID NO: 59234 - DNA, 20 bp, Artificial Sequence
  sgRNA
  Taar8c_9
ccaatgcatcaattgtgtat

SEQ ID NO: 59235 - DNA, 20 bp, Artificial Sequence
  sgRNA
  Taar8c_10
aagttgttgtcaatcaagac

SEQ ID NO: 59236 - DNA, 20 bp, Artificial Sequence
  sgRNA
  Taar8c_11
cccatacacaattgatgcat

SEQ ID NO: 59237 - DNA, 20 bp, Artificial Sequence
  sgRNA
  Taar8c_12
catagctgtcacggaccctc

SEQ ID NO: 59238 - DNA, 20 bp, Artificial Sequence
  sgRNA
  Taar8c_13
tttaagtgggaaaattctaa

SEQ ID NO: 59239 - DNA, 20 bp, Artificial Sequence
  sgRNA
  Taar8c_14
tgcattggttgatgctttca

SEQ ID NO: 59240 - DNA, 20 bp, Artificial Sequence
  sgRNA
  Taar9_1
ccagcagggctcccaaaccg

SEQ ID NO: 59241 - DNA, 20 bp, Artificial Sequence
  sgRNA
  Taar9_2
aggaggtgtcgaaacacgtg

SEQ ID NO: 59242 - DNA, 20 bp, Artificial Sequence
  sgRNA
  Taar9_3
gatctgtaactgcaatgtac

SEQ ID NO: 59243 - DNA, 20 bp, Artificial Sequence
  sgRNA
  Taar9_4
tgtgcagctgtttaaagtgg

SEQ ID NO: 59244 - DNA, 20 bp, Artificial Sequence
  sgRNA
  Taar9_5
acagaacgcaccgtgctgaa

SEQ ID NO: 59245 - DNA, 20 bp, Artificial Sequence
  sgRNA
  Taar9_6
aatatctcatagacgtacgc

SEQ ID NO: 59246 - DNA, 20 bp, Artificial Sequence
  sgRNA
  Taar9_7
ttaaaagctcttacgcaccc

SEQ ID NO: 59247 - DNA, 20 bp, Artificial Sequence
  sgRNA
  Taar9_8
ggctccactgaatcaaaatt

SEQ ID NO: 59248 - DNA, 20 bp, Artificial Sequence
  sgRNA
  Taar9_9
ataaccgcatcaataatgta

SEQ ID NO: 59249 - DNA, 20 bp, Artificial Sequence
  sgRNA
  Taar9_10
tcatggtgtttctatatggt

SEQ ID NO: 59250 - DNA, 20 bp, Artificial Sequence
  sgRNA
  Taar9_11
tcatagcagagctccatggg

SEQ ID NO: 59251 - DNA, 20 bp, Artificial Sequence
  sgRNA
  Taar9_12
tatcaggctaggaagataga

SEQ ID NO: 59252 - DNA, 20 bp, Artificial Sequence
  sgRNA
  Taar9_13
ggaaggctgccaagaccttg

SEQ ID NO: 59253 - DNA, 20 bp, Artificial Sequence
  sgRNA
  Taar9_14
gcctcgagccatcctctatg

SEQ ID NO: 59254 - DNA, 20 bp, Artificial Sequence
  sgRNA
  Taar9_15
ccaaaccgaggaccccatag

SEQ ID NO: 59255 - DNA, 20 bp, Artificial Sequence
  sgRNA
  Taar9_16
cacgcctacgaacttcctgg

SEQ ID NO: 59256 - DNA, 20 bp, Artificial Sequence
  sgRNA
  Taar9_17
attggctcccgtgtaaaaga

SEQ ID NO: 59257 - DNA, 20 bp, Artificial Sequence
  sgRNA
  Taar9_18
acacgggagccaatgaggaa

SEQ ID NO: 59258 - DNA, 20 bp, Artificial Sequence
  sgRNA
  Taar9_19
tagaggatggctcgaggcca

SEQ ID NO: 59259 - DNA, 20 bp, Artificial Sequence
  sgRNA
  Taar9_20
gctgccatacattattgatg

SEQ ID NO: 59260 - DNA, 20 bp, Artificial Sequence
  sgRNA
  Tacr1_1
catggctgcattcaatacag

SEQ ID NO: 59261 - DNA, 20 bp, Artificial Sequence
  sgRNA
  Tacr1_2
ggtggtcaaaatgatgatcg

SEQ ID NO: 59262 - DNA, 20 bp, Artificial Sequence
  sgRNA
  Tacr1_3
gattggctatgcatacactg

SEQ ID NO: 59263 - DNA, 20 bp, Artificial Sequence
  sgRNA
  Tacr1_4
caccacgatgaccgtatagg

SEQ ID NO: 59264 - DNA, 20 bp, Artificial Sequence
  sgRNA
  Tacr1_5
gtagcagtggccgacagccg

SEQ ID NO: 59265 - DNA, 20 bp, Artificial Sequence
  sgRNA
  Tacr1_6
gcatagccaatcaccagcag

SEQ ID NO: 59266 - DNA, 20 bp, Artificial Sequence
  sgRNA
  Tacr1_7
gcaagtctctgccaagcgca

SEQ ID NO: 59267 - DNA, 20 bp, Artificial Sequence
  sgRNA
  Tacr1_8
tcagtgctggtgattatgag

SEQ ID NO: 59268 - DNA, 20 bp, Artificial Sequence
  sgRNA
  Tacr1_9
ggtcttcgagttgcttcgag

SEQ ID NO: 59269 - DNA, 20 bp, Artificial Sequence
  sgRNA
  Tacr1_10
gtaacggtcagaggagtcac

SEQ ID NO: 59270 - DNA, 20 bp, Artificial Sequence
  sgRNA
  Tacr1_11
ggtgaacctggccttcgctg

SEQ ID NO: 59271 - DNA, 20 bp, Artificial Sequence
  sgRNA
  Tacr1_12
cctacgcagtccacaacgtg

SEQ ID NO: 59272 - DNA, 20 bp, Artificial Sequence
  sgRNA
  Tacr1_13
agtggccagaacatcccaac

SEQ ID NO: 59273 - DNA, 20 bp, Artificial Sequence
  sgRNA
  Tacr1_14
ctgggtctggaggtatcggg

SEQ ID NO: 59274 - DNA, 20 bp, Artificial Sequence
  sgRNA
  Tacr1_15
tgtgaaacttgcagtaaaag

SEQ ID NO: 59275 - DNA, 20 bp, Artificial Sequence
  sgRNA
  Tacr1_16
ggagaccaccatctccactg

SEQ ID NO: 59276 - DNA, 20 bp, Artificial Sequence
  sgRNA
  Tacr1_17
gctatgcatacactgtggta

SEQ ID NO: 59277 - DNA, 20 bp, Artificial Sequence
  sgRNA
  Tacr1_18
ccttaagaagttcatccagc

SEQ ID NO: 59278 - DNA, 20 bp, Artificial Sequence
  sgRNA
  Tacr1_19
aggcatgcttgaagcccaga

SEQ ID NO: 59279 - DNA, 20 bp, Artificial Sequence
  sgRNA
  Tacr1_20
tgcccaaaggacaatttgcc

SEQ ID NO: 59280 - DNA, 20 bp, Artificial Sequence
  sgRNA
  Tacr2_1
gaagtaccagatgttgtgac

SEQ ID NO: 59281 - DNA, 20 bp, Artificial Sequence
  sgRNA
  Tacr2_2
ggcccatgagagaatgcgca

SEQ ID NO: 59282 - DNA, 20 bp, Artificial Sequence
  sgRNA
  Tacr2_3
cggcgcgtttccacagtgtg

SEQ ID NO: 59283 - DNA, 20 bp, Artificial Sequence
  sgRNA
  Tacr2_4
ggtggagtagaaacattgtg

SEQ ID NO: 59284 - DNA, 20 bp, Artificial Sequence
  sgRNA
  Tacr2_5
ctaccgcaagtttatccagc

SEQ ID NO: 59285 - DNA, 20 bp, Artificial Sequence
  sgRNA
  Tacr2_6
tgtcaccaccaccagtacca

SEQ ID NO: 59286 - DNA, 20 bp, Artificial Sequence
  sgRNA
  Tacr2_7
tgttacagccaccagcacca

SEQ ID NO: 59287 - DNA, 20 bp, Artificial Sequence
  sgRNA
  Tacr2_8
agacctgctggataaacttg

SEQ ID NO: 59288 - DNA, 20 bp, Artificial Sequence
  sgRNA
  Tacr2_9
ttgtccaccctttccagcca

SEQ ID NO: 59289 - DNA, 20 bp, Artificial Sequence
  sgRNA
  Tacr2_10
gctgcaaacatcaccactag

SEQ ID NO: 59290 - DNA, 20 bp, Artificial Sequence
  sgRNA
  Tacr2_11
agtcaaccggtgtcacacca

SEQ ID NO: 59291 - DNA, 20 bp, Artificial Sequence
  sgRNA
  Tacr2_12
cctcggttggtgtcccccag

SEQ ID NO: 59292 - DNA, 20 bp, Artificial Sequence
  sgRNA
  Tacr2_13
tttctactccaccatcactg

SEQ ID NO: 59293 - DNA, 20 bp, Artificial Sequence
  sgRNA
  Tacr2_14
gcctggcccaatgacaacgg

SEQ ID NO: 59294 - DNA, 20 bp, Artificial Sequence
  sgRNA
  Tacr2_15
cccactctgaggctaccaat

SEQ ID NO: 59295 - DNA, 20 bp, Artificial Sequence
  sgRNA
  Tacr2_16
gttacagccttctctatgcc

SEQ ID NO: 59296 - DNA, 20 bp, Artificial Sequence
  sgRNA
  Tacr2_17
ggggcccccaacctgcccat

SEQ ID NO: 59297 - DNA, 20 bp, Artificial Sequence
  sgRNA
  Tacr2_18
aggcggttattgctgtcatc

SEQ ID NO: 59298 - DNA, 20 bp, Artificial Sequence
  sgRNA
  Tacr2_19
ttgtggggaggcgagagcca

SEQ ID NO: 59299 - DNA, 20 bp, Artificial Sequence
  sgRNA
  Tacr2_20
gaccgtgcgcattctctcat

SEQ ID NO: 59300 - DNA, 20 bp, Artificial Sequence
  sgRNA
  Tacr3_1
gcagcttaaggctaaacgaa

SEQ ID NO: 59301 - DNA, 20 bp, Artificial Sequence
  sgRNA
  Tacr3_2
ccagagcgcgattcgccagg

SEQ ID NO: 59302 - DNA, 20 bp, Artificial Sequence
  sgRNA
  Tacr3_3
ccagagagtaattccaacga

SEQ ID NO: 59303 - DNA, 20 bp, Artificial Sequence
  sgRNA
  Tacr3_4
actgcacatagcaaagggta

SEQ ID NO: 59304 - DNA, 20 bp, Artificial Sequence
  sgRNA
  Tacr3_5
ggctttctccgacgcctccg

SEQ ID NO: 59305 - DNA, 20 bp, Artificial Sequence
  sgRNA
  Tacr3_6
acagccactaagattgtcat

SEQ ID NO: 59306 - DNA, 20 bp, Artificial Sequence
  sgRNA
  Tacr3_7
tggccactgcacatagcaaa

SEQ ID NO: 59307 - DNA, 20 bp, Artificial Sequence
  sgRNA
  Tacr3_8
gcttcaagagagcatttcgc

SEQ ID NO: 59308 - DNA, 20 bp, Artificial Sequence
  sgRNA
  Tacr3_9
ccaccaggtttcatcccaca

SEQ ID NO: 59309 - DNA, 20 bp, Artificial Sequence
  sgRNA
  Tacr3_10
cctcctggcgaatcgcgctc

SEQ ID NO: 59310 - DNA, 20 bp, Artificial Sequence
  sgRNA
  Tacr3_11
accatagatgaaattgacca

SEQ ID NO: 59311 - DNA, 20 bp, Artificial Sequence
  sgRNA
  Tacr3_12
tctatggtgttcacagcgag

SEQ ID NO: 59312 - DNA, 20 bp, Artificial Sequence
  sgRNA
  Tacr3_13
caggtggaaatacatccagc

SEQ ID NO: 59313 - DNA, 20 bp, Artificial Sequence
  sgRNA
  Tacr3_14
ggtgtcacctacaccatcgt

SEQ ID NO: 59314 - DNA, 20 bp, Artificial Sequence
  sgRNA
  Tacr3_15
tggccgggtccccttcactg

SEQ ID NO: 59315 - DNA, 20 bp, Artificial Sequence
  sgRNA
  Tacr3_16
tgtcactggcaagcccagcg

SEQ ID NO: 59316 - DNA, 20 bp, Artificial Sequence
  sgRNA
  Tacr3_17
gctgcacgaactggttcgtc

SEQ ID NO: 59317 - DNA, 20 bp, Artificial Sequence
  sgRNA
  Tacr3_18
tgctgtatgaccccagtgaa

SEQ ID NO: 59318 - DNA, 20 bp, Artificial Sequence
  sgRNA
  Tacr3_19
agctggagctcaagaccacc

SEQ ID NO: 59319 - DNA, 20 bp, Artificial Sequence
  sgRNA
  Tacr3_20
tgacagccattgcagtggac

SEQ ID NO: 59320 - DNA, 20 bp, Artificial Sequence
  sgRNA
  Tacstd2_1
gggctcctcatagtgtaccg

SEQ ID NO: 59321 - DNA, 20 bp, Artificial Sequence
  sgRNA
  Tacstd2_2
cgtcacactccgggtcgtag

SEQ ID NO: 59322 - DNA, 20 bp, Artificial Sequence
  sgRNA
  Tacstd2_3
gtttacgcaccagcacaccg

SEQ ID NO: 59323 - DNA, 20 bp, Artificial Sequence
  sgRNA
  Tacstd2_4
ctgacctagactccgagctg

SEQ ID NO: 59324 - DNA, 20 bp, Artificial Sequence
  sgRNA
  Tacstd2_5
agcgtccgctccacatgcag

SEQ ID NO: 59325 - DNA, 20 bp, Artificial Sequence
  sgRNA
  Tacstd2_6
ccaccattcagatagagctt

SEQ ID NO: 59326 - DNA, 20 bp, Artificial Sequence
  sgRNA
  Tacstd2_7
gcgccagtgcaaccagacct

SEQ ID NO: 59327 - DNA, 20 bp, Artificial Sequence
  sgRNA
  Tacstd2_8
gtccctttcgaagtagtagg

SEQ ID NO: 59328 - DNA, 20 bp, Artificial Sequence
  sgRNA
  Tacstd2_9
ggtgtgctggtgcgtaaact

SEQ ID NO: 59329 - DNA, 20 bp, Artificial Sequence
  sgRNA
  Tacstd2_10
gcaccccagcttcctatccg

SEQ ID NO: 59330 - DNA, 20 bp, Artificial Sequence
  sgRNA
  Tacstd2_11
cctatccgcggtacactatg

SEQ ID NO: 59331 - DNA, 20 bp, Artificial Sequence
  sgRNA
  Tacstd2_12
ggcggtggcgcaactcaatg

SEQ ID NO: 59332 - DNA, 20 bp, Artificial Sequence
  sgRNA
  Tacstd2_13
cgacacaaatggcccaggcg

SEQ ID NO: 59333 - DNA, 20 bp, Artificial Sequence
  sgRNA
  Tacstd2_14
tgccgcctactacttcgaaa

SEQ ID NO: 59334 - DNA, 20 bp, Artificial Sequence
  sgRNA
  Tacstd2_15
acctagactccgagctgcgg

SEQ ID NO: 59335 - DNA, 20 bp, Artificial Sequence
  sgRNA
  Tacstd2_16
gatgacggcaatgacgccgg

SEQ ID NO: 59336 - DNA, 20 bp, Artificial Sequence
  sgRNA
  Tacstd2_17
catcgctgtcgtctcggtag

SEQ ID NO: 59337 - DNA, 20 bp, Artificial Sequence
  sgRNA
  Tacstd2_18
cctcatagtgtaccgcggat

SEQ ID NO: 59338 - DNA, 20 bp, Artificial Sequence
  sgRNA
  Tacstd2_19
cacgcgatactggacaacga

SEQ ID NO: 59339 - DNA, 20 bp, Artificial Sequence
  sgRNA
  Tacstd2_20
aagcctgcgctgcgacgaag

SEQ ID NO: 59340 - DNA, 20 bp, Artificial Sequence
  sgRNA
  Tarm1_1
tcctttcaagcccaccaccg

SEQ ID NO: 59341 - DNA, 20 bp, Artificial Sequence
  sgRNA
  Tarm1_2
gaggatgaagtatttactcg

SEQ ID NO: 59342 - DNA, 20 bp, Artificial Sequence
  sgRNA
  Tarm1_3
gccatcattctgtcgtaggt

SEQ ID NO: 59343 - DNA, 20 bp, Artificial Sequence
  sgRNA
  Tarm1_4
gggtgtgacggtgtgtcatg

SEQ ID NO: 59344 - DNA, 20 bp, Artificial Sequence
  sgRNA
  Tarm1_5
gctgcaatcctgctaatagt

SEQ ID NO: 59345 - DNA, 20 bp, Artificial Sequence
  sgRNA
  Tarm1_6
gaagccatataatttgacag

SEQ ID NO: 59346 - DNA, 20 bp, Artificial Sequence
  sgRNA
  Tarm1_7
accgacctacgacagaatga

SEQ ID NO: 59347 - DNA, 20 bp, Artificial Sequence
  sgRNA
  Tarm1_8
tcttacattgcattgtcacg

SEQ ID NO: 59348 - DNA, 20 bp, Artificial Sequence
  sgRNA
  Tarm1_9
ttcctgcagtcactgtaccc

SEQ ID NO: 59349 - DNA, 20 bp, Artificial Sequence
  sgRNA
  Tarm1_10
ctgcagtcactgtaccccgg

SEQ ID NO: 59350 - DNA, 20 bp, Artificial Sequence
  sgRNA
  Tarm1_11
accccgggtacaatgacaga

SEQ ID NO: 59351 - DNA, 20 bp, Artificial Sequence
  sgRNA
  Tarm1_12
cactgtgccaggcttcaacc

SEQ ID NO: 59352 - DNA, 20 bp, Artificial Sequence
  sgRNA
  Tarm1_13
ggaagcctcccactattagc

SEQ ID NO: 59353 - DNA, 20 bp, Artificial Sequence
  sgRNA
  Tarm1_14
gacctacgacagaatgatgg

SEQ ID NO: 59354 - DNA, 20 bp, Artificial Sequence
  sgRNA
  Tarm1_15
gctgggccctgaggcccgat

SEQ ID NO: 59355 - DNA, 20 bp, Artificial Sequence
  sgRNA
  Tarm1_16
aggttgctgtcagttgcggt

SEQ ID NO: 59356 - DNA, 20 bp, Artificial Sequence
  sgRNA
  Tarm1_17
gccttctgtcattgtacccg

SEQ ID NO: 59357 - DNA, 20 bp, Artificial Sequence
  sgRNA
  Tarm1_18
acaagaaaagggcattgctg

SEQ ID NO: 59358 - DNA, 20 bp, Artificial Sequence
  sgRNA
  Tarm1_19
atgtgacagccagagactcg

SEQ ID NO: 59359 - DNA, 20 bp, Artificial Sequence
  sgRNA
  Tarm1_20
ccatttgctatagtattcac

SEQ ID NO: 59360 - DNA, 20 bp, Artificial Sequence
  sgRNA
  Tas1r1_1
atgatgtcataataacctag

SEQ ID NO: 59361 - DNA, 20 bp, Artificial Sequence
  sgRNA
  Tas1r1_2
gggacatttctcaacacgag

SEQ ID NO: 59362 - DNA, 20 bp, Artificial Sequence
  sgRNA
  Tas1r1_3
aaggcgacgcagatgccccg

SEQ ID NO: 59363 - DNA, 20 bp, Artificial Sequence
  sgRNA
  Tas1r1_4
ggaacttgcgcttcccactg

SEQ ID NO: 59364 - DNA, 20 bp, Artificial Sequence
  sgRNA
  Tas1r1_5
gtcatacagttcatacccca

SEQ ID NO: 59365 - DNA, 20 bp, Artificial Sequence
  sgRNA
  Tas1r1_6
gccgcactatgacttccacc

SEQ ID NO: 59366 - DNA, 20 bp, Artificial Sequence
  sgRNA
  Tas1r1_7
ccccagcgataagtaccagg

SEQ ID NO: 59367 - DNA, 20 bp, Artificial Sequence
  sgRNA
  Tas1r1_8
tgagggtgctcgcccagcaa

SEQ ID NO: 59368 - DNA, 20 bp, Artificial Sequence
  sgRNA
  Tas1r1_9
cctgccagcacattgaccgc

SEQ ID NO: 59369 - DNA, 20 bp, Artificial Sequence
  sgRNA
  Tas1r1_10
gttagagaagaccacgacca

SEQ ID NO: 59370 - DNA, 20 bp, Artificial Sequence
  sgRNA
  Tas1r1_11
cctccatccaggactacacg

SEQ ID NO: 59371 - DNA, 20 bp, Artificial Sequence
  sgRNA
  Tas1r1_12
gaatcacgtagcatttaggg

SEQ ID NO: 59372 - DNA, 20 bp, Artificial Sequence
  sgRNA
  Tas1r1_13
ggctcgagccaggaccaccg

SEQ ID NO: 59373 - DNA, 20 bp, Artificial Sequence
  sgRNA
  Tas1r1_14
gcttcttcagcagatctaca

SEQ ID NO: 59374 - DNA, 20 bp, Artificial Sequence
  sgRNA
  Tas1r1_15
tgttgtgtgcgaaagccacc

SEQ ID NO: 59375 - DNA, 20 bp, Artificial Sequence
  sgRNA
  Tas1r1_16
gcaaacccgagagaaaagag

SEQ ID NO: 59376 - DNA, 20 bp, Artificial Sequence
  sgRNA
  Tas1r1_17
gctggccgttgcttactgct

SEQ ID NO: 59377 - DNA, 20 bp, Artificial Sequence
  sgRNA
  Tas1r1_18
tgaaccgcatggcttggaag

SEQ ID NO: 59378 - DNA, 20 bp, Artificial Sequence
  sgRNA
  Tas1r1_19
ggcttgcaatgtggacccca

SEQ ID NO: 59379 - DNA, 20 bp, Artificial Sequence
  sgRNA
  Tas1r1_20
ggagatggcccagtcttcgg

SEQ ID NO: 59380 - DNA, 20 bp, Artificial Sequence
  sgRNA
  Tas1r2_1
acctactgatcggttgaggt

SEQ ID NO: 59381 - DNA, 20 bp, Artificial Sequence
  sgRNA
  Tas1r2_2
gtgaaccatcagttgcacca

SEQ ID NO: 59382 - DNA, 20 bp, Artificial Sequence
  sgRNA
  Tas1r2_3
cagaacccaaccaggccgtg

SEQ ID NO: 59383 - DNA, 20 bp, Artificial Sequence
  sgRNA
  Tas1r2_4
tgtgtactcggccgtctacg

SEQ ID NO: 59384 - DNA, 20 bp, Artificial Sequence
  sgRNA
  Tas1r2_5
gcaggccatgcgattcgccg

SEQ ID NO: 59385 - DNA, 20 bp, Artificial Sequence
  sgRNA
  Tas1r2_6
cctgcacaacttcttccgcg

SEQ ID NO: 59386 - DNA, 20 bp, Artificial Sequence
  sgRNA
  Tas1r2_7
ggtttcagcttcgcgtacgt

SEQ ID NO: 59387 - DNA, 20 bp, Artificial Sequence
  sgRNA
  Tas1r2_8
ccgacaagctgcgagacaag

SEQ ID NO: 59388 - DNA, 20 bp, Artificial Sequence
  sgRNA
  Tas1r2_9
acatcgcttgcttcaagcgg

SEQ ID NO: 59389 - DNA, 20 bp, Artificial Sequence
  sgRNA
  Tas1r2_10
cctactcccccaccgagacg

SEQ ID NO: 59390 - DNA, 20 bp, Artificial Sequence
  sgRNA
  Tas1r2_11
gctcttcttcgacgaacaag

SEQ ID NO: 59391 - DNA, 20 bp, Artificial Sequence
  sgRNA
  Tas1r2_12
agctcttcttcgacgaacaa

SEQ ID NO: 59392 - DNA, 20 bp, Artificial Sequence
  sgRNA
  Tas1r2_13
ccgcttgtctcgcagcttgt

SEQ ID NO: 59393 - DNA, 20 bp, Artificial Sequence
  sgRNA
  Tas1r2_14
gtagcccgttgcggtagtta

SEQ ID NO: 59394 - DNA, 20 bp, Artificial Sequence
  sgRNA
  Tas1r2_15
gtaacgcatccagaaaccgt

SEQ ID NO: 59395 - DNA, 20 bp, Artificial Sequence
  sgRNA
  Tas1r2_16
gcaccacgatccagttccac

SEQ ID NO: 59396 - DNA, 20 bp, Artificial Sequence
  sgRNA
  Tas1r2_17
gagtgtgtggactgtccgcc

SEQ ID NO: 59397 - DNA, 20 bp, Artificial Sequence
  sgRNA
  Tas1r2_18
gggtaaagaggccacccagg

SEQ ID NO: 59398 - DNA, 20 bp, Artificial Sequence
  sgRNA
  Tas1r2_19
tatcaccaccacacgcgccg

SEQ ID NO: 59399 - DNA, 20 bp, Artificial Sequence
  sgRNA
  Tas1r2_20
tggatgatgtccaggagcat

SEQ ID NO: 59400 - DNA, 20 bp, Artificial Sequence
  sgRNA
  Tas1r3_1
agcatgatgtcgtcacaccg

SEQ ID NO: 59401 - DNA, 20 bp, Artificial Sequence
  sgRNA
  Tas1r3_2
gtagaacatgttctgatacg

SEQ ID NO: 59402 - DNA, 20 bp, Artificial Sequence
  sgRNA
  Tas1r3_3
gtgccacaacatgacactag

SEQ ID NO: 59403 - DNA, 20 bp, Artificial Sequence
  sgRNA
  Tas1r3_4
atttcccctgggctcaaccg

SEQ ID NO: 59404 - DNA, 20 bp, Artificial Sequence
  sgRNA
  Tas1r3_5
gctagcttatttcatcacct

SEQ ID NO: 59405 - DNA, 20 bp, Artificial Sequence
  sgRNA
  Tas1r3_6
ggtatctgcatcgcacatga

SEQ ID NO: 59406 - DNA, 20 bp, Artificial Sequence
  sgRNA
  Tas1r3_7
gtagtgtcaagtctcgagca

SEQ ID NO: 59407 - DNA, 20 bp, Artificial Sequence
  sgRNA
  Tas1r3_8
acacctgtattacatactgt

SEQ ID NO: 59408 - DNA, 20 bp, Artificial Sequence
  sgRNA
  Tas1r3_9
gctgtggaggagatcaacaa

SEQ ID NO: 59409 - DNA, 20 bp, Artificial Sequence
  sgRNA
  Tas1r3_10
gtcatcatcactccctaagg

SEQ ID NO: 59410 - DNA, 20 bp, Artificial Sequence
  sgRNA
  Tas1r3_11
gcaccaggcaaagcagcagg

SEQ ID NO: 59411 - DNA, 20 bp, Artificial Sequence
  sgRNA
  Tas1r3_12
gagtgatgatgactatggcc

SEQ ID NO: 59412 - DNA, 20 bp, Artificial Sequence
  sgRNA
  Tas1r3_13
atccaactccgcattcagtg

SEQ ID NO: 59413 - DNA, 20 bp, Artificial Sequence
  sgRNA
  Tas1r3_14
tgttgcagaacctatcagct

SEQ ID NO: 59414 - DNA, 20 bp, Artificial Sequence
  sgRNA
  Tas1r3_15
atagtcatcatcactcccta

SEQ ID NO: 59415 - DNA, 20 bp, Artificial Sequence
  sgRNA
  Tas1r3_16
gctatagtgccagcatggat

SEQ ID NO: 59416 - DNA, 20 bp, Artificial Sequence
  sgRNA
  Tas1r3_17
gctcggagcatgtgtcaaat

SEQ ID NO: 59417 - DNA, 20 bp, Artificial Sequence
  sgRNA
  Tas1r3_18
ggggctctctgtccaccact

SEQ ID NO: 59418 - DNA, 20 bp, Artificial Sequence
  sgRNA
  Tas1r3_19
ccttcccaggaagaactcct

SEQ ID NO: 59419 - DNA, 20 bp, Artificial Sequence
  sgRNA
  Tas1r3_20
tctgcaacagcccagatgat

SEQ ID NO: 59420 - DNA, 20 bp, Artificial Sequence
  sgRNA
  Tas2r103_1
tgtcaaagacacagcgaatg

SEQ ID NO: 59421 - DNA, 20 bp, Artificial Sequence
  sgRNA
  Tas2r103_2
tctcgtgaacatcatagact

SEQ ID NO: 59422 - DNA, 20 bp, Artificial Sequence
  sgRNA
  Tas2r103_3
tgggaatgagaacgatggta

SEQ ID NO: 59423 - DNA, 20 bp, Artificial Sequence
  sgRNA
  Tas2r103_4
aaaagtggtatcagtgacat

SEQ ID NO: 59424 - DNA, 20 bp, Artificial Sequence
  sgRNA
  Tas2r103_5
ttctcattcccaataaagct

SEQ ID NO: 59425 - DNA, 20 bp, Artificial Sequence
  sgRNA
  Tas2r103_6
gtttccaagaatcagtacac

SEQ ID NO: 59426 - DNA, 20 bp, Artificial Sequence
  sgRNA
  Tas2r103_7
caaatgggaagctaaaaaag

SEQ ID NO: 59427 - DNA, 20 bp, Artificial Sequence
  sgRNA
  Tas2r103_8
ataagtctggagtttatcat

SEQ ID NO: 59428 - DNA, 20 bp, Artificial Sequence
  sgRNA
  Tas2r103_9
agcagtcctggagatggcca

SEQ ID NO: 59429 - DNA, 20 bp, Artificial Sequence
  sgRNA
  Tas2r103_10
agtacacaggagtggcctgt

SEQ ID NO: 59430 - DNA, 20 bp, Artificial Sequence
  sgRNA
  Tas2r103_11
ggataagacctatatggccc

SEQ ID NO: 59431 - DNA, 20 bp, Artificial Sequence
  sgRNA
  Tas2r103_12
attgtcaaagacacagcgaa

SEQ ID NO: 59432 - DNA, 20 bp, Artificial Sequence
  sgRNA
  Tas2r103_13
aagaggaaagatctctgcag

SEQ ID NO: 59433 - DNA, 20 bp, Artificial Sequence
  sgRNA
  Tas2r103_14
gctccttactatttcctgga

SEQ ID NO: 59434 - DNA, 20 bp, Artificial Sequence
  sgRNA
  Tas2r103_15
tttattgggaatgagaacga

SEQ ID NO: 59435 - DNA, 20 bp, Artificial Sequence
  sgRNA
  Tas2r103_16
tcaccatccaggaaatagta

SEQ ID NO: 59436 - DNA, 20 bp, Artificial Sequence
  sgRNA
  Tas2r103_17
agcagtatatagtaacagga

SEQ ID NO: 59437 - DNA, 20 bp, Artificial Sequence
  sgRNA
  Tas2r103_18
ggagatggccagggccatat

SEQ ID NO: 59438 - DNA, 20 bp, Artificial Sequence
  sgRNA
  Tas2r103_19
ctccagagatgtcagcacag

SEQ ID NO: 59439 - DNA, 20 bp, Artificial Sequence
  sgRNA
  Tas2r103_20
gtaacactttaaaagattat

SEQ ID NO: 59440 - DNA, 20 bp, Artificial Sequence
  sgRNA
  Tas2r104_1
acttgtaaactacacagact

SEQ ID NO: 59441 - DNA, 20 bp, Artificial Sequence
  sgRNA
  Tas2r104_2
tcggcataagcatagtcaga

SEQ ID NO: 59442 - DNA, 20 bp, Artificial Sequence
  sgRNA
  Tas2r104_3
ttgtattcttaattataacg

SEQ ID NO: 59443 - DNA, 20 bp, Artificial Sequence
  sgRNA
  Tas2r104_4
catccagagaaatatgtagt

SEQ ID NO: 59444 - DNA, 20 bp, Artificial Sequence
  sgRNA
  Tas2r104_5
gctgaagcaagccactatga

SEQ ID NO: 59445 - DNA, 20 bp, Artificial Sequence
  sgRNA
  Tas2r104_6
ttaatgaccttcacagctag

SEQ ID NO: 59446 - DNA, 20 bp, Artificial Sequence
  sgRNA
  Tas2r104_7
tgaatgcatgagttacatat

SEQ ID NO: 59447 - DNA, 20 bp, Artificial Sequence
  sgRNA
  Tas2r104_8
tcatccagagaaatatgtag

SEQ ID NO: 59448 - DNA, 20 bp, Artificial Sequence
  sgRNA
  Tas2r104_9
ggaatggcaacagggataca

SEQ ID NO: 59449 - DNA, 20 bp, Artificial Sequence
  sgRNA
  Tas2r104_10
ctgcctgctgtgtctccaaa

SEQ ID NO: 59450 - DNA, 20 bp, Artificial Sequence
  sgRNA
  Tas2r104_11
gctccctgcttgttagaatt

SEQ ID NO: 59451 - DNA, 20 bp, Artificial Sequence
  sgRNA
  Tas2r104_12
tctctgcagtgccctcatag

SEQ ID NO: 59452 - DNA, 20 bp, Artificial Sequence
  sgRNA
  Tas2r104_13
gtaactcactcttctccagg

SEQ ID NO: 59453 - DNA, 20 bp, Artificial Sequence
  sgRNA
  Tas2r104_14
tatcctaattctaacaagca

SEQ ID NO: 59454 - DNA, 20 bp, Artificial Sequence
  sgRNA
  Tas2r104_15
tcagaaaataaaagatgccg

SEQ ID NO: 59455 - DNA, 20 bp, Artificial Sequence
  sgRNA
  Tas2r104_16
gttccctaaaactcccagca

SEQ ID NO: 59456 - DNA, 20 bp, Artificial Sequence
  sgRNA
  Tas2r104_17
tgctaaaccaaacgctcaga

SEQ ID NO: 59457 - DNA, 20 bp, Artificial Sequence
  sgRNA
  Tas2r104_18
cttctccaggtggatcagcc

SEQ ID NO: 59458 - DNA, 20 bp, Artificial Sequence
  sgRNA
  Tas2r104_19
aattatggctacaataaaga

SEQ ID NO: 59459 - DNA, 20 bp, Artificial Sequence
  sgRNA
  Tas2r104_20
ttagaattaggataaaggaa

SEQ ID NO: 59460 - DNA, 20 bp, Artificial Sequence
  sgRNA
  Tas2r105_1
aagttgctaagccgatgaga

SEQ ID NO: 59461 - DNA, 20 bp, Artificial Sequence
  sgRNA
  Tas2r105_2
gaatcatagaaacaggacct

SEQ ID NO: 59462 - DNA, 20 bp, Artificial Sequence
  sgRNA
  Tas2r105_3
gagaaatgactccaatattg

SEQ ID NO: 59463 - DNA, 20 bp, Artificial Sequence
  sgRNA
  Tas2r105_4
gtgtatttctctggttgaag

SEQ ID NO: 59464 - DNA, 20 bp, Artificial Sequence
  sgRNA
  Tas2r105_5
tttctcccagtacatctccg

SEQ ID NO: 59465 - DNA, 20 bp, Artificial Sequence
  sgRNA
  Tas2r105_6
gttgtgaaggtgatgaagga

SEQ ID NO: 59466 - DNA, 20 bp, Artificial Sequence
  sgRNA
  Tas2r105_7
gctaaagcaagcctttgtaa

SEQ ID NO: 59467 - DNA, 20 bp, Artificial Sequence
  sgRNA
  Tas2r105_8
atgactggcttccttctcat

SEQ ID NO: 59468 - DNA, 20 bp, Artificial Sequence
  sgRNA
  Tas2r105_9
gcaactgttgaagctgggct

SEQ ID NO: 59469 - DNA, 20 bp, Artificial Sequence
  sgRNA
  Tas2r105_10
tattgcactggtaaactgca

SEQ ID NO: 59470 - DNA, 20 bp, Artificial Sequence
  sgRNA
  Tas2r105_11
tgtcactttggagacacagc

SEQ ID NO: 59471 - DNA, 20 bp, Artificial Sequence
  sgRNA
  Tas2r105_12
caaccagagaaatacacagt

SEQ ID NO: 59472 - DNA, 20 bp, Artificial Sequence
  sgRNA
  Tas2r105_13
cccagcttcaacagttgcaa

SEQ ID NO: 59473 - DNA, 20 bp, Artificial Sequence
  sgRNA
  Tas2r105_14
tccttgcagtacctttacaa

SEQ ID NO: 59474 - DNA, 20 bp, Artificial Sequence
  sgRNA
  Tas2r105_15
ccattgcaactgttgaagct

SEQ ID NO: 59475 - DNA, 20 bp, Artificial Sequence
  sgRNA
  Tas2r105_16
atttgttgtgaaggtgatga

SEQ ID NO: 59476 - DNA, 20 bp, Artificial Sequence
  sgRNA
  Tas2r105_17
gtaaagtgaatcatagaaac

SEQ ID NO: 59477 - DNA, 20 bp, Artificial Sequence
  sgRNA
  Tas2r105_18
gcctttgtaaaggtactgca

SEQ ID NO: 59478 - DNA, 20 bp, Artificial Sequence
  sgRNA
  Tas2r105_19
ttgaaatcatctcttatata

SEQ ID NO: 59479 - DNA, 20 bp, Artificial Sequence
  sgRNA
  Tas2r105_20
caacagttgcaatggaaagg

SEQ ID NO: 59480 - DNA, 20 bp, Artificial Sequence
  sgRNA
  Tas2r106_1
atatgtataataatctctga

SEQ ID NO: 59481 - DNA, 20 bp, Artificial Sequence
  sgRNA
  Tas2r106_2
taaagaagaatataactccc

SEQ ID NO: 59482 - DNA, 20 bp, Artificial Sequence
  sgRNA
  Tas2r106_3
gtaagaaatcactataatgt

SEQ ID NO: 59483 - DNA, 20 bp, Artificial Sequence
  sgRNA
  Tas2r106_4
gagatagaagaggttgaggc

SEQ ID NO: 59484 - DNA, 20 bp, Artificial Sequence
  sgRNA
  Tas2r106_5
gtaactagtggttcagtcct

SEQ ID NO: 59485 - DNA, 20 bp, Artificial Sequence
  sgRNA
  Tas2r106_6
gctgactgtttgctagaatt

SEQ ID NO: 59486 - DNA, 20 bp, Artificial Sequence
  sgRNA
  Tas2r106_7
acagctggctttattctcac

SEQ ID NO: 59487 - DNA, 20 bp, Artificial Sequence
  sgRNA
  Tas2r106_8
gctgaagcaggcttctttga

SEQ ID NO: 59488 - DNA, 20 bp, Artificial Sequence
  sgRNA
  Tas2r106_9
cactagttacaaaacaaagg

SEQ ID NO: 59489 - DNA, 20 bp, Artificial Sequence
  sgRNA
  Tas2r106_10
ctatcttcaggagatagaag

SEQ ID NO: 59490 - DNA, 20 bp, Artificial Sequence
  sgRNA
  Tas2r106_11
acagtatttatctttctcct

SEQ ID NO: 59491 - DNA, 20 bp, Artificial Sequence
  sgRNA
  Tas2r106_12
aaccactagttacaaaacaa

SEQ ID NO: 59492 - DNA, 20 bp, Artificial Sequence
  sgRNA
  Tas2r106_13
atccatttcctagaactccc

SEQ ID NO: 59493 - DNA, 20 bp, Artificial Sequence
  sgRNA
  Tas2r106_14
gcatcagaggcaaccatatg

SEQ ID NO: 59494 - DNA, 20 bp, Artificial Sequence
  sgRNA
  Tas2r106_15
tgttaatcttgcatttcata

SEQ ID NO: 59495 - DNA, 20 bp, Artificial Sequence
  sgRNA
  Tas2r106_16
ttatcaatcatacaagtata

SEQ ID NO: 59496 - DNA, 20 bp, Artificial Sequence
  sgRNA
  Tas2r106_17
aggataaatgaatgacagca

SEQ ID NO: 59497 - DNA, 20 bp, Artificial Sequence
  sgRNA
  Tas2r106_18
ctatgaaatgcaagattaac

SEQ ID NO: 59498 - DNA, 20 bp, Artificial Sequence
  sgRNA
  Tas2r106_19
aaaatgccataagaaagaca

SEQ ID NO: 59499 - DNA, 20 bp, Artificial Sequence
  sgRNA
  Tas2r106_20
cttatagaggtaaacctgcc

SEQ ID NO: 59500 - DNA, 20 bp, Artificial Sequence
  sgRNA
  Tas2r107_1
tggaaaacatagtaaccatg

SEQ ID NO: 59501 - DNA, 20 bp, Artificial Sequence
  sgRNA
  Tas2r107_2
atattcagttatgtttccag

SEQ ID NO: 59502 - DNA, 20 bp, Artificial Sequence
  sgRNA
  Tas2r107_3
caacagaaagcaggtaatca

SEQ ID NO: 59503 - DNA, 20 bp, Artificial Sequence
  sgRNA
  Tas2r107_4
aacaagaagctctctaagat

SEQ ID NO: 59504 - DNA, 20 bp, Artificial Sequence
  sgRNA
  Tas2r107_5
gccacatgcctctatccctg

SEQ ID NO: 59505 - DNA, 20 bp, Artificial Sequence
  sgRNA
  Tas2r107_6
cctcactagtgacaacacaa

SEQ ID NO: 59506 - DNA, 20 bp, Artificial Sequence
  sgRNA
  Tas2r107_7
acgatgattgagtgaccgca

SEQ ID NO: 59507 - DNA, 20 bp, Artificial Sequence
  sgRNA
  Tas2r107_8
caggatgcttacttacctca

SEQ ID NO: 59508 - DNA, 20 bp, Artificial Sequence
  sgRNA
  Tas2r107_9
cactagtgacaacacaaagg

SEQ ID NO: 59509 - DNA, 20 bp, Artificial Sequence
  sgRNA
  Tas2r107_10
aataaactgctctttataac

SEQ ID NO: 59510 - DNA, 20 bp, Artificial Sequence
  sgRNA
  Tas2r107_11
tttccacacatgcttacctc

SEQ ID NO: 59511 - DNA, 20 bp, Artificial Sequence
  sgRNA
  Tas2r107_12
aagatcggtttcattctcat

SEQ ID NO: 59512 - DNA, 20 bp, Artificial Sequence
  sgRNA
  Tas2r107_13
tagctatctttagaaagtag

SEQ ID NO: 59513 - DNA, 20 bp, Artificial Sequence
  sgRNA
  Tas2r107_14
gttaaagcaagcctctttga

SEQ ID NO: 59514 - DNA, 20 bp, Artificial Sequence
  sgRNA
  Tas2r107_15
ggcttggcgatttccagaat

SEQ ID NO: 59515 - DNA, 20 bp, Artificial Sequence
  sgRNA
  Tas2r107_16
tttgtctgacatgtctccag

SEQ ID NO: 59516 - DNA, 20 bp, Artificial Sequence
  sgRNA
  Tas2r107_17
ttagaaagtagaggatgttg

SEQ ID NO: 59517 - DNA, 20 bp, Artificial Sequence
  sgRNA
  Tas2r107_18
ttgctgcagtgccttcaaag

SEQ ID NO: 59518 - DNA, 20 bp, Artificial Sequence
  sgRNA
  Tas2r107_19
aataaagcatagcacttcta

SEQ ID NO: 59519 - DNA, 20 bp, Artificial Sequence
  sgRNA
  Tas2r107_20
cagccagagaaatacagagt

SEQ ID NO: 59520 - DNA, 20 bp, Artificial Sequence
  sgRNA
  Tas2r108_1
gtttcaacaggagaaacact

SEQ ID NO: 59521 - DNA, 20 bp, Artificial Sequence
  sgRNA
  Tas2r108_2
gagcatataatataggagag

SEQ ID NO: 59522 - DNA, 20 bp, Artificial Sequence
  sgRNA
  Tas2r108_3
acgtcaagataccatcactg

SEQ ID NO: 59523 - DNA, 20 bp, Artificial Sequence
  sgRNA
  Tas2r108_4
caaagtcaggaatctagtga

SEQ ID NO: 59524 - DNA, 20 bp, Artificial Sequence
  sgRNA
  Tas2r108_5
ccccagacggaggctcacat

SEQ ID NO: 59525 - DNA, 20 bp, Artificial Sequence
  sgRNA
  Tas2r108_6
agattcttcctcatatagga

SEQ ID NO: 59526 - DNA, 20 bp, Artificial Sequence
  sgRNA
  Tas2r108_7
ataatataggagagtggtga

SEQ ID NO: 59527 - DNA, 20 bp, Artificial Sequence
  sgRNA
  Tas2r108_8
aatatggaatgtagagcacg

SEQ ID NO: 59528 - DNA, 20 bp, Artificial Sequence
  sgRNA
  Tas2r108_9
acattgctacaaatactgga

SEQ ID NO: 59529 - DNA, 20 bp, Artificial Sequence
  sgRNA
  Tas2r108_10
gtagaaacaaccccaaagtc

SEQ ID NO: 59530 - DNA, 20 bp, Artificial Sequence
  sgRNA
  Tas2r108_11
acgtcatttgacctcagtga

SEQ ID NO: 59531 - DNA, 20 bp, Artificial Sequence
  sgRNA
  Tas2r108_12
tctcaaggaatgtattaaca

SEQ ID NO: 59532 - DNA, 20 bp, Artificial Sequence
  sgRNA
  Tas2r108_13
tcagaagacaggccaacagc

SEQ ID NO: 59533 - DNA, 20 bp, Artificial Sequence
  sgRNA
  Tas2r108_14
aggaggacagaatgtcctgg

SEQ ID NO: 59534 - DNA, 20 bp, Artificial Sequence
  sgRNA
  Tas2r108_15
tctatcttccttcctatatg

SEQ ID NO: 59535 - DNA, 20 bp, Artificial Sequence
  sgRNA
  Tas2r108_16
tctgtgagagcatataatat

SEQ ID NO: 59536 - DNA, 20 bp, Artificial Sequence
  sgRNA
  Tas2r108_17
tacaaaatttaaaaaaaccg

SEQ ID NO: 59537 - DNA, 20 bp, Artificial Sequence
  sgRNA
  Tas2r108_18
gcagaattgcctctccggat

SEQ ID NO: 59538 - DNA, 20 bp, Artificial Sequence
  sgRNA
  Tas2r108_19
tagagatagtccgtttcaac

SEQ ID NO: 59539 - DNA, 20 bp, Artificial Sequence
  sgRNA
  Tas2r108_20
tatgatgtgtgataatgagg

SEQ ID NO: 59540 - DNA, 20 bp, Artificial Sequence
  sgRNA
  Tas2r109_1
tagaagttgccaaagcggtg

SEQ ID NO: 59541 - DNA, 20 bp, Artificial Sequence
  sgRNA
  Tas2r109_2
gtctagtagtaactaaatat

SEQ ID NO: 59542 - DNA, 20 bp, Artificial Sequence
  sgRNA
  Tas2r109_3
ccagtccatgcagtgcacca

SEQ ID NO: 59543 - DNA, 20 bp, Artificial Sequence
  sgRNA
  Tas2r109_4
tgagaaaataaaagacactg

SEQ ID NO: 59544 - DNA, 20 bp, Artificial Sequence
  sgRNA
  Tas2r109_5
tcagaatcaagacatatgaa

SEQ ID NO: 59545 - DNA, 20 bp, Artificial Sequence
  sgRNA
  Tas2r109_6
cctgaatttgacaacttaaa

SEQ ID NO: 59546 - DNA, 20 bp, Artificial Sequence
  sgRNA
  Tas2r109_7
gaggtttcttccttaatcca

SEQ ID NO: 59547 - DNA, 20 bp, Artificial Sequence
  sgRNA
  Tas2r109_8
ctactagcatgaaccagagc

SEQ ID NO: 59548 - DNA, 20 bp, Artificial Sequence
  sgRNA
  Tas2r109_9
tgacaaaatgcaatgaaagg

SEQ ID NO: 59549 - DNA, 20 bp, Artificial Sequence
  sgRNA
  Tas2r109_10
ccacgacaacacagagagag

SEQ ID NO: 59550 - DNA, 20 bp, Artificial Sequence
  sgRNA
  Tas2r109_11
ataattggacttataggaaa

SEQ ID NO: 59551 - DNA, 20 bp, Artificial Sequence
  sgRNA
  Tas2r109_12
caaggctttgaagtgggccg

SEQ ID NO: 59552 - DNA, 20 bp, Artificial Sequence
  sgRNA
  Tas2r109_13
tacagttcactagtactcta

SEQ ID NO: 59553 - DNA, 20 bp, Artificial Sequence
  sgRNA
  Tas2r109_14
tagcaaaccagacactaata

SEQ ID NO: 59554 - DNA, 20 bp, Artificial Sequence
  sgRNA
  Tas2r109_15
ctgctctggttcatgctagt

SEQ ID NO: 59555 - DNA, 20 bp, Artificial Sequence
  sgRNA
  Tas2r109_16
cttggtgcactgcatggact

SEQ ID NO: 59556 - DNA, 20 bp, Artificial Sequence
  sgRNA
  Tas2r109_17
tgttgtcgtggctgaaatgc

SEQ ID NO: 59557 - DNA, 20 bp, Artificial Sequence
  sgRNA
  Tas2r109_18
cctctctctctgtgttgtcg

SEQ ID NO: 59558 - DNA, 20 bp, Artificial Sequence
  sgRNA
  Tas2r109_19
aaaattgtagtaacagtgac

SEQ ID NO: 59559 - DNA, 20 bp, Artificial Sequence
  sgRNA
  Tas2r109_20
agtctagtagtaactaaata

SEQ ID NO: 59560 - DNA, 20 bp, Artificial Sequence
  sgRNA
  Tas2r110_1
ataaaagacaccgaggcatg

SEQ ID NO: 59561 - DNA, 20 bp, Artificial Sequence
  sgRNA
  Tas2r110_2
aaatacatcttataatttag

SEQ ID NO: 59562 - DNA, 20 bp, Artificial Sequence
  sgRNA
  Tas2r110_3
ctgatcttgtaagcaaatgt

SEQ ID NO: 59563 - DNA, 20 bp, Artificial Sequence
  sgRNA
  Tas2r110_4
aaaccacacatagagaaatc

SEQ ID NO: 59564 - DNA, 20 bp, Artificial Sequence
  sgRNA
  Tas2r110_5
tcagaaatagtaacatcaat

SEQ ID NO: 59565 - DNA, 20 bp, Artificial Sequence
  sgRNA
  Tas2r110_6
ttaccagatttctctatgtg

SEQ ID NO: 59566 - DNA, 20 bp, Artificial Sequence
  sgRNA
  Tas2r110_7
acctagagatgccagcacca

SEQ ID NO: 59567 - DNA, 20 bp, Artificial Sequence
  sgRNA
  Tas2r110_8
tcagaaaataaaagacaccg

SEQ ID NO: 59568 - DNA, 20 bp, Artificial Sequence
  sgRNA
  Tas2r110_9
tggtgtccatatctttggat

SEQ ID NO: 59569 - DNA, 20 bp, Artificial Sequence
  sgRNA
  Tas2r110_10
gaggtgccgatccaaagata

SEQ ID NO: 59570 - DNA, 20 bp, Artificial Sequence
  sgRNA
  Tas2r110_11
gaaaacctattccagaaatg

SEQ ID NO: 59571 - DNA, 20 bp, Artificial Sequence
  sgRNA
  Tas2r110_12
catacatgcttagagataac

SEQ ID NO: 59572 - DNA, 20 bp, Artificial Sequence
  sgRNA
  Tas2r110_13
ccagaatcagcacaaatgag

SEQ ID NO: 59573 - DNA, 20 bp, Artificial Sequence
  sgRNA
  Tas2r110_14
ttatttgtggaattagtaat

SEQ ID NO: 59574 - DNA, 20 bp, Artificial Sequence
  sgRNA
  Tas2r110_15
gagaagaagcatttcatcag

SEQ ID NO: 59575 - DNA, 20 bp, Artificial Sequence
  sgRNA
  Tas2r110_16
tactgcatacagcagcagga

SEQ ID NO: 59576 - DNA, 20 bp, Artificial Sequence
  sgRNA
  Tas2r110_17
atggtgctggcatctctagg

SEQ ID NO: 59577 - DNA, 20 bp, Artificial Sequence
  sgRNA
  Tas2r110_18
ttgagccttaggttgatagg

SEQ ID NO: 59578 - DNA, 20 bp, Artificial Sequence
  sgRNA
  Tas2r110_19
agtatactgcatacagcagc

SEQ ID NO: 59579 - DNA, 20 bp, Artificial Sequence
  sgRNA
  Tas2r110_20
tttaatgtgggccatggtgc

SEQ ID NO: 59580 - DNA, 20 bp, Artificial Sequence
  sgRNA
  Tas2r113_1
gaaaaatagagacactaaca

SEQ ID NO: 59581 - DNA, 20 bp, Artificial Sequence
  sgRNA
  Tas2r113_2
tgtgaacatagggttagtaa

SEQ ID NO: 59582 - DNA, 20 bp, Artificial Sequence
  sgRNA
  Tas2r113_3
gttgatattcctagattggt

SEQ ID NO: 59583 - DNA, 20 bp, Artificial Sequence
  sgRNA
  Tas2r113_4
tgctaattgccagagcagtg

SEQ ID NO: 59584 - DNA, 20 bp, Artificial Sequence
  sgRNA
  Tas2r113_5
attaccgtggacataacaaa

SEQ ID NO: 59585 - DNA, 20 bp, Artificial Sequence
  sgRNA
  Tas2r113_6
agacacaatgatggtttgca

SEQ ID NO: 59586 - DNA, 20 bp, Artificial Sequence
  sgRNA
  Tas2r113_7
aattccatactgaaaattat

SEQ ID NO: 59587 - DNA, 20 bp, Artificial Sequence
  sgRNA
  Tas2r113_8
gagcaaagaaaacattaccg

SEQ ID NO: 59588 - DNA, 20 bp, Artificial Sequence
  sgRNA
  Tas2r113_9
ggttgatattcctagattgg

SEQ ID NO: 59589 - DNA, 20 bp, Artificial Sequence
  sgRNA
  Tas2r113_10
ctttgctcatcttctccctg

SEQ ID NO: 59590 - DNA, 20 bp, Artificial Sequence
  sgRNA
  Tas2r113_11
ttcagtatggaattcataat

SEQ ID NO: 59591 - DNA, 20 bp, Artificial Sequence
  sgRNA
  Tas2r113_12
ttagcagaatcgctctaatt

SEQ ID NO: 59592 - DNA, 20 bp, Artificial Sequence
  sgRNA
  Tas2r113_13
agaaaaatagagacactaac

SEQ ID NO: 59593 - DNA, 20 bp, Artificial Sequence
  sgRNA
  Tas2r113_14
cagggctctgatgtgcactg

SEQ ID NO: 59594 - DNA, 20 bp, Artificial Sequence
  sgRNA
  Tas2r113_15
gatgtctctgcatcctttgg

SEQ ID NO: 59595 - DNA, 20 bp, Artificial Sequence
  sgRNA
  Tas2r113_16
ataatgggaaccttaggaaa

SEQ ID NO: 59596 - DNA, 20 bp, Artificial Sequence
  sgRNA
  Tas2r113_17
tttaccaaaatcatgacaaa

SEQ ID NO: 59597 - DNA, 20 bp, Artificial Sequence
  sgRNA
  Tas2r113_18
ggtaaacagaagattgagat

SEQ ID NO: 59598 - DNA, 20 bp, Artificial Sequence
  sgRNA
  Tas2r113_19
aatatgcagcacaccgccaa

SEQ ID NO: 59599 - DNA, 20 bp, Artificial Sequence
  sgRNA
  Tas2r113_20
aacatatttgatttcctgga

SEQ ID NO: 59600 - DNA, 20 bp, Artificial Sequence
  sgRNA
  Tas2r114_1
ctgtgattaagatcaacaca

SEQ ID NO: 59601 - DNA, 20 bp, Artificial Sequence
  sgRNA
  Tas2r114_2
aaataaaaatactcccccat

SEQ ID NO: 59602 - DNA, 20 bp, Artificial Sequence
  sgRNA
  Tas2r114_3
ttaaccagacaaatatgtag

SEQ ID NO: 59603 - DNA, 20 bp, Artificial Sequence
  sgRNA
  Tas2r114_4
aggctgtgctgggcattgta

SEQ ID NO: 59604 - DNA, 20 bp, Artificial Sequence
  sgRNA
  Tas2r114_5
ttaaccatcttcgcaacaac

SEQ ID NO: 59605 - DNA, 20 bp, Artificial Sequence
  sgRNA
  Tas2r114_6
cactagttgaaactgaaagg

SEQ ID NO: 59606 - DNA, 20 bp, Artificial Sequence
  sgRNA
  Tas2r114_7
ttgacaggagacagcaactg

SEQ ID NO: 59607 - DNA, 20 bp, Artificial Sequence
  sgRNA
  Tas2r114_8
tcctaattctagcaaacagt

SEQ ID NO: 59608 - DNA, 20 bp, Artificial Sequence
  sgRNA
  Tas2r114_9
tttcactttggagacatcgc

SEQ ID NO: 59609 - DNA, 20 bp, Artificial Sequence
  sgRNA
  Tas2r114_10
cctttcagtttcaactagtg

SEQ ID NO: 59610 - DNA, 20 bp, Artificial Sequence
  sgRNA
  Tas2r114_11
ctagaattaggataagtgag

SEQ ID NO: 59611 - DNA, 20 bp, Artificial Sequence
  sgRNA
  Tas2r114_12
cctcactagttgaaactgaa

SEQ ID NO: 59612 - DNA, 20 bp, Artificial Sequence
  sgRNA
  Tas2r114_13
acaactgcattcatctatcc

SEQ ID NO: 59613 - DNA, 20 bp, Artificial Sequence
  sgRNA
  Tas2r114_14
tgtgttgatcttaatcacag

SEQ ID NO: 59614 - DNA, 20 bp, Artificial Sequence
  sgRNA
  Tas2r114_15
atgagctcaattatgttgac

SEQ ID NO: 59615 - DNA, 20 bp, Artificial Sequence
  sgRNA
  Tas2r114_16
taaactgtatggactataac

SEQ ID NO: 59616 - DNA, 20 bp, Artificial Sequence
  sgRNA
  Tas2r114_17
gccgactgtttgctagaatt

SEQ ID NO: 59617 - DNA, 20 bp, Artificial Sequence
  sgRNA
  Tas2r114_18
taaccatcttcgcaacaact

SEQ ID NO: 59618 - DNA, 20 bp, Artificial Sequence
  sgRNA
  Tas2r114_19
agataagcaagcaccctatc

SEQ ID NO: 59619 - DNA, 20 bp, Artificial Sequence
  sgRNA
  Tas2r114_20
cattgcacttgtaaactgta

SEQ ID NO: 59620 - DNA, 20 bp, Artificial Sequence
  sgRNA
  Tas2r115_1
gctatcaaggatacaccaaa

SEQ ID NO: 59621 - DNA, 20 bp, Artificial Sequence
  sgRNA
  Tas2r115_2
ggggaatggattcatagctc

SEQ ID NO: 59622 - DNA, 20 bp, Artificial Sequence
  sgRNA
  Tas2r115_3
atttctagtcatcagtaatg

SEQ ID NO: 59623 - DNA, 20 bp, Artificial Sequence
  sgRNA
  Tas2r115_4
tgaagagataaaagatgctg

SEQ ID NO: 59624 - DNA, 20 bp, Artificial Sequence
  sgRNA
  Tas2r115_5
gtgcaagcgtgagaaaacct

SEQ ID NO: 59625 - DNA, 20 bp, Artificial Sequence
  sgRNA
  Tas2r115_6
cctgaagcggagagttaaaa

SEQ ID NO: 59626 - DNA, 20 bp, Artificial Sequence
  sgRNA
  Tas2r115_7
gaaggcaaccacagtctgca

SEQ ID NO: 59627 - DNA, 20 bp, Artificial Sequence
  sgRNA
  Tas2r115_8
agttcttcattggaaatctg

SEQ ID NO: 59628 - DNA, 20 bp, Artificial Sequence
  sgRNA
  Tas2r115_9
tgaggaaatgatctgctgaa

SEQ ID NO: 59629 - DNA, 20 bp, Artificial Sequence
  sgRNA
  Tas2r115_10
atgttcacattagtaccctt

SEQ ID NO: 59630 - DNA, 20 bp, Artificial Sequence
  sgRNA
  Tas2r115_11
gtatttctagtcatcagtaa

SEQ ID NO: 59631 - DNA, 20 bp, Artificial Sequence
  sgRNA
  Tas2r115_12
aagatgcagtactacaccaa

SEQ ID NO: 59632 - DNA, 20 bp, Artificial Sequence
  sgRNA
  Tas2r115_13
ggaagtttcaacacttgaaa

SEQ ID NO: 59633 - DNA, 20 bp, Artificial Sequence
  sgRNA
  Tas2r115_14
catagctctggtacaatgca

SEQ ID NO: 59634 - DNA, 20 bp, Artificial Sequence
  sgRNA
  Tas2r115_15
atgcaaagatgtcagaacca

SEQ ID NO: 59635 - DNA, 20 bp, Artificial Sequence
  sgRNA
  Tas2r115_16
actaatgtgaacattaaact

SEQ ID NO: 59636 - DNA, 20 bp, Artificial Sequence
  sgRNA
  Tas2r115_17
tttcccttatgaaacatgta

SEQ ID NO: 59637 - DNA, 20 bp, Artificial Sequence
  sgRNA
  Tas2r115_18
cttccttacatgtttcataa

SEQ ID NO: 59638 - DNA, 20 bp, Artificial Sequence
  sgRNA
  Tas2r115_19
agtagtatataataggagga

SEQ ID NO: 59639 - DNA, 20 bp, Artificial Sequence
  sgRNA
  Tas2r115_20
tatcagagcaagcctggaga

SEQ ID NO: 59640 - DNA, 20 bp, Artificial Sequence
  sgRNA
  Tas2r116_1
ctttggcaatggattcatag

SEQ ID NO: 59641 - DNA, 20 bp, Artificial Sequence
  sgRNA
  Tas2r116_2
aaaaggtatgaacccaaaca

SEQ ID NO: 59642 - DNA, 20 bp, Artificial Sequence
  sgRNA
  Tas2r116_3
tagcaaaccagagactactc

SEQ ID NO: 59643 - DNA, 20 bp, Artificial Sequence
  sgRNA
  Tas2r116_4
gacttaaaaaagtcatgata

SEQ ID NO: 59644 - DNA, 20 bp, Artificial Sequence
  sgRNA
  Tas2r116_5
gtgaccagtgacacagcaaa

SEQ ID NO: 59645 - DNA, 20 bp, Artificial Sequence
  sgRNA
  Tas2r116_6
gctggcatctctgcatccat

SEQ ID NO: 59646 - DNA, 20 bp, Artificial Sequence
  sgRNA
  Tas2r116_7
ctttctctgatgtttccaca

SEQ ID NO: 59647 - DNA, 20 bp, Artificial Sequence
  sgRNA
  Tas2r116_8
ggaagaaaatggaatacagg

SEQ ID NO: 59648 - DNA, 20 bp, Artificial Sequence
  sgRNA
  Tas2r116_9
ataattggcatctttggcaa

SEQ ID NO: 59649 - DNA, 20 bp, Artificial Sequence
  sgRNA
  Tas2r116_10
tatcagtcatccattgtcct

SEQ ID NO: 59650 - DNA, 20 bp, Artificial Sequence
  sgRNA
  Tas2r116_11
tatgaacccaaacatggtgt

SEQ ID NO: 59651 - DNA, 20 bp, Artificial Sequence
  sgRNA
  Tas2r116_12
tctccagaattgcactgctg

SEQ ID NO: 59652 - DNA, 20 bp, Artificial Sequence
  sgRNA
  Tas2r116_13
aagatgcaacacagtgccca

SEQ ID NO: 59653 - DNA, 20 bp, Artificial Sequence
  sgRNA
  Tas2r116_14
tggatatttgtgctttaccc

SEQ ID NO: 59654 - DNA, 20 bp, Artificial Sequence
  sgRNA
  Tas2r116_15
caacctgtgtgatcaaaagc

SEQ ID NO: 59655 - DNA, 20 bp, Artificial Sequence
  sgRNA
  Tas2r116_16
tggcaatggattcatagcgg

SEQ ID NO: 59656 - DNA, 20 bp, Artificial Sequence
  sgRNA
  Tas2r116_17
gggcaatgctaagatgagaa

SEQ ID NO: 59657 - DNA, 20 bp, Artificial Sequence
  sgRNA
  Tas2r116_18
ggagtgctctgcttctggag

SEQ ID NO: 59658 - DNA, 20 bp, Artificial Sequence
  sgRNA
  Tas2r116_19
atgcagagatgccagcacta

SEQ ID NO: 59659 - DNA, 20 bp, Artificial Sequence
  sgRNA
  Tas2r116_20
tgactataaatgtaacctgt

SEQ ID NO: 59660 - DNA, 20 bp, Artificial Sequence
  sgRNA
  Tas2r117_1
tcttaacccagtccatacag

SEQ ID NO: 59661 - DNA, 20 bp, Artificial Sequence
  sgRNA
  Tas2r117_2
ctaacttggaaaccgacatg

SEQ ID NO: 59662 - DNA, 20 bp, Artificial Sequence
  sgRNA
  Tas2r117_3
ttagaaaataaaggacagtg

SEQ ID NO: 59663 - DNA, 20 bp, Artificial Sequence
  sgRNA
  Tas2r117_4
cagatttaactacaagttca

SEQ ID NO: 59664 - DNA, 20 bp, Artificial Sequence
  sgRNA
  Tas2r117_5
ttaatcgtggaattagtaat

SEQ ID NO: 59665 - DNA, 20 bp, Artificial Sequence
  sgRNA
  Tas2r117_6
cctggtccactgtatggact

SEQ ID NO: 59666 - DNA, 20 bp, Artificial Sequence
  sgRNA
  Tas2r117_7
agtaagaatttgattaacta

SEQ ID NO: 59667 - DNA, 20 bp, Artificial Sequence
  sgRNA
  Tas2r117_8
aatccagatgctgaaatggt

SEQ ID NO: 59668 - DNA, 20 bp, Artificial Sequence
  sgRNA
  Tas2r117_9
gtaaaatatttaaaatcagg

SEQ ID NO: 59669 - DNA, 20 bp, Artificial Sequence
  sgRNA
  Tas2r117_10
atattcatttgtccacatgt

SEQ ID NO: 59670 - DNA, 20 bp, Artificial Sequence
  sgRNA
  Tas2r117_11
tacaagtcatgtacaatgct

SEQ ID NO: 59671 - DNA, 20 bp, Artificial Sequence
  sgRNA
  Tas2r117_12
aaatgactgaaagtgtgctc

SEQ ID NO: 59672 - DNA, 20 bp, Artificial Sequence
  sgRNA
  Tas2r117_13
tggctatctttagaaaataa

SEQ ID NO: 59673 - DNA, 20 bp, Artificial Sequence
  sgRNA
  Tas2r117_14
catggtcctggtccactgta

SEQ ID NO: 59674 - DNA, 20 bp, Artificial Sequence
  sgRNA
  Tas2r117_15
gtaattggaattataggaaa

SEQ ID NO: 59675 - DNA, 20 bp, Artificial Sequence
  sgRNA
  Tas2r117_16
tgtctgtcttaatacaaatt

SEQ ID NO: 59676 - DNA, 20 bp, Artificial Sequence
  sgRNA
  Tas2r117_17
tagccaaccatttcagcatc

SEQ ID NO: 59677 - DNA, 20 bp, Artificial Sequence
  sgRNA
  Tas2r117_18
tagcaatccagatgctgaaa

SEQ ID NO: 59678 - DNA, 20 bp, Artificial Sequence
  sgRNA
  Tas2r117_19
cccagtccatacagtggacc

SEQ ID NO: 59679 - DNA, 20 bp, Artificial Sequence
  sgRNA
  Tas2r117_20
aggaaatgggttcatggtcc

SEQ ID NO: 59680 - DNA, 20 bp, Artificial Sequence
  sgRNA
  Tas2r118_1
ttggaaggtatcagtcgtct

SEQ ID NO: 59681 - DNA, 20 bp, Artificial Sequence
  sgRNA
  Tas2r118_2
tgttaaatatcacatccaga

SEQ ID NO: 59682 - DNA, 20 bp, Artificial Sequence
  sgRNA
  Tas2r118_3
ctttcaaagactgtcaccgg

SEQ ID NO: 59683 - DNA, 20 bp, Artificial Sequence
  sgRNA
  Tas2r118_4
aattgtgcaaagttgcacaa

SEQ ID NO: 59684 - DNA, 20 bp, Artificial Sequence
  sgRNA
  Tas2r118_5
tgtgatatttaacaacagaa

SEQ ID NO: 59685 - DNA, 20 bp, Artificial Sequence
  sgRNA
  Tas2r118_6
gagaagatggtgacttgcgt

SEQ ID NO: 59686 - DNA, 20 bp, Artificial Sequence
  sgRNA
  Tas2r118_7
agtgaactgagctttcaggc

SEQ ID NO: 59687 - DNA, 20 bp, Artificial Sequence
  sgRNA
  Tas2r118_8
ctgatgagaatcgtctccac

SEQ ID NO: 59688 - DNA, 20 bp, Artificial Sequence
  sgRNA
  Tas2r118_9
tgagtaagatgatagaagcc

SEQ ID NO: 59689 - DNA, 20 bp, Artificial Sequence
  sgRNA
  Tas2r118_10
gcactttcaaagactgtcac

SEQ ID NO: 59690 - DNA, 20 bp, Artificial Sequence
  sgRNA
  Tas2r118_11
ctagggtgactaattccatc

SEQ ID NO: 59691 - DNA, 20 bp, Artificial Sequence
  sgRNA
  Tas2r118_12
acatcaatgctatacaactt

SEQ ID NO: 59692 - DNA, 20 bp, Artificial Sequence
  sgRNA
  Tas2r118_13
gtagaggacagcaagccaac

SEQ ID NO: 59693 - DNA, 20 bp, Artificial Sequence
  sgRNA
  Tas2r118_14
ctggttctctggttgatact

SEQ ID NO: 59694 - DNA, 20 bp, Artificial Sequence
  sgRNA
  Tas2r118_15
aagagaccttgacacagtag

SEQ ID NO: 59695 - DNA, 20 bp, Artificial Sequence
  sgRNA
  Tas2r118_16
tcactcaccccatcttcctc

SEQ ID NO: 59696 - DNA, 20 bp, Artificial Sequence
  sgRNA
  Tas2r118_17
gagcaaccctgcattgaaaa

SEQ ID NO: 59697 - DNA, 20 bp, Artificial Sequence
  sgRNA
  Tas2r118_18
tctaatcctttaaaaatgat

SEQ ID NO: 59698 - DNA, 20 bp, Artificial Sequence
  sgRNA
  Tas2r118_19
tgacattctggttaaccagt

SEQ ID NO: 59699 - DNA, 20 bp, Artificial Sequence
  sgRNA
  Tas2r118_20
ttgcagtgctattcagagag

SEQ ID NO: 59700 - DNA, 20 bp, Artificial Sequence
  sgRNA
  Tas2r119_1
gtagaaaacaccaagccatg

SEQ ID NO: 59701 - DNA, 20 bp, Artificial Sequence
  sgRNA
  Tas2r119_2
acagatgccaggatcagcca

SEQ ID NO: 59702 - DNA, 20 bp, Artificial Sequence
  sgRNA
  Tas2r119_3
aaaaagaagcagatccagtg

SEQ ID NO: 59703 - DNA, 20 bp, Artificial Sequence
  sgRNA
  Tas2r119_4
ctgacgagggcatgtctgct

SEQ ID NO: 59704 - DNA, 20 bp, Artificial Sequence
  sgRNA
  Tas2r119_5
ggagagcatcgcactgacga

SEQ ID NO: 59705 - DNA, 20 bp, Artificial Sequence
  sgRNA
  Tas2r119_6
ctgccggctgtggttccaca

SEQ ID NO: 59706 - DNA, 20 bp, Artificial Sequence
  sgRNA
  Tas2r119_7
gcaacagtgaagatgagaaa

SEQ ID NO: 59707 - DNA, 20 bp, Artificial Sequence
  sgRNA
  Tas2r119_8
tcttcagccacagaaagagt

SEQ ID NO: 59708 - DNA, 20 bp, Artificial Sequence
  sgRNA
  Tas2r119_9
aggttctgcttccaaagtgg

SEQ ID NO: 59709 - DNA, 20 bp, Artificial Sequence
  sgRNA
  Tas2r119_10
actgcactaccacaaccagg

SEQ ID NO: 59710 - DNA, 20 bp, Artificial Sequence
  sgRNA
  Tas2r119_11
agacaatcgagtgtaaggag

SEQ ID NO: 59711 - DNA, 20 bp, Artificial Sequence
  sgRNA
  Tas2r119_12
aagacaatcgagtgtaagga

SEQ ID NO: 59712 - DNA, 20 bp, Artificial Sequence
  sgRNA
  Tas2r119_13
cggcagatgaggactatggt

SEQ ID NO: 59713 - DNA, 20 bp, Artificial Sequence
  sgRNA
  Tas2r119_14
cttccacatgatcaagtcga

SEQ ID NO: 59714 - DNA, 20 bp, Artificial Sequence
  sgRNA
  Tas2r119_15
ttacatagaccacagatgcc

SEQ ID NO: 59715 - DNA, 20 bp, Artificial Sequence
  sgRNA
  Tas2r119_16
ccatgtcatgggagagatag

SEQ ID NO: 59716 - DNA, 20 bp, Artificial Sequence
  sgRNA
  Tas2r119_17
gagtgatgagtagcaggcac

SEQ ID NO: 59717 - DNA, 20 bp, Artificial Sequence
  sgRNA
  Tas2r119_18
ccaccatagtcctcatctgc

SEQ ID NO: 59718 - DNA, 20 bp, Artificial Sequence
  sgRNA
  Tas2r119_19
gagagtagtgtggcatgcgc

SEQ ID NO: 59719 - DNA, 20 bp, Artificial Sequence
  sgRNA
  Tas2r119_20
cttggcaaatggcctcattg

SEQ ID NO: 59720 - DNA, 20 bp, Artificial Sequence
  sgRNA
  Tas2r120_1
agttataattcgatcagctg

SEQ ID NO: 59721 - DNA, 20 bp, Artificial Sequence
  sgRNA
  Tas2r120_2
tttggttgcatatcttggga

SEQ ID NO: 59722 - DNA, 20 bp, Artificial Sequence
  sgRNA
  Tas2r120_3
cagccaagtggtaaaatggt

SEQ ID NO: 59723 - DNA, 20 bp, Artificial Sequence
  sgRNA
  Tas2r120_4
cagttcagtgatataccaaa

SEQ ID NO: 59724 - DNA, 20 bp, Artificial Sequence
  sgRNA
  Tas2r120_5
acagtcgatgaagttcacta

SEQ ID NO: 59725 - DNA, 20 bp, Artificial Sequence
  sgRNA
  Tas2r120_6
atgtcaagatcagagcacca

SEQ ID NO: 59726 - DNA, 20 bp, Artificial Sequence
  sgRNA
  Tas2r120_7
gcttggatgagtattcatga

SEQ ID NO: 59727 - DNA, 20 bp, Artificial Sequence
  sgRNA
  Tas2r120_8
ccaacctgatataatgacac

SEQ ID NO: 59728 - DNA, 20 bp, Artificial Sequence
  sgRNA
  Tas2r120_9
attggatccttctacccagc

SEQ ID NO: 59729 - DNA, 20 bp, Artificial Sequence
  sgRNA
  Tas2r120_10
gggaaaccagaaacttaaac

SEQ ID NO: 59730 - DNA, 20 bp, Artificial Sequence
  sgRNA
  Tas2r120_11
tccccagccaagtggtaaaa

SEQ ID NO: 59731 - DNA, 20 bp, Artificial Sequence
  sgRNA
  Tas2r120_12
tgaacatcaagaagattgct

SEQ ID NO: 59732 - DNA, 20 bp, Artificial Sequence
  sgRNA
  Tas2r120_13
cagtatggtccccagccaag

SEQ ID NO: 59733 - DNA, 20 bp, Artificial Sequence
  sgRNA
  Tas2r120_14
cataaaggccttgcaaactg

SEQ ID NO: 59734 - DNA, 20 bp, Artificial Sequence
  sgRNA
  Tas2r120_15
gagcaccatggtccacataa

SEQ ID NO: 59735 - DNA, 20 bp, Artificial Sequence
  sgRNA
  Tas2r120_16
aatatgaaattctatggcaa

SEQ ID NO: 59736 - DNA, 20 bp, Artificial Sequence
  sgRNA
  Tas2r120_17
cctgtgtcattatatcaggt

SEQ ID NO: 59737 - DNA, 20 bp, Artificial Sequence
  sgRNA
  Tas2r120_18
agatacaagaatgacctgct

SEQ ID NO: 59738 - DNA, 20 bp, Artificial Sequence
  sgRNA
  Tas2r120_19
tagatgaagaaatagactgt

SEQ ID NO: 59739 - DNA, 20 bp, Artificial Sequence
  sgRNA
  Tas2r120_20
cattcttgtatcttgatttg

SEQ ID NO: 59740 - DNA, 20 bp, Artificial Sequence
  sgRNA
  Tas2r123_1
gtaacgggaatcttaggaca

SEQ ID NO: 59741 - DNA, 20 bp, Artificial Sequence
  sgRNA
  Tas2r123_2
ctgatctcctaggcaaatgt

SEQ ID NO: 59742 - DNA, 20 bp, Artificial Sequence
  sgRNA
  Tas2r123_3
gttgatgggtaagaaaacat

SEQ ID NO: 59743 - DNA, 20 bp, Artificial Sequence
  sgRNA
  Tas2r123_4
tcaagaaaatcagtgatgcc

SEQ ID NO: 59744 - DNA, 20 bp, Artificial Sequence
  sgRNA
  Tas2r123_5
tatggcatacagcagcagga

SEQ ID NO: 59745 - DNA, 20 bp, Artificial Sequence
  sgRNA
  Tas2r123_6
tgattgaaaaagtaaacaaa

SEQ ID NO: 59746 - DNA, 20 bp, Artificial Sequence
  sgRNA
  Tas2r123_7
gacataaatgaatctggtaa

SEQ ID NO: 59747 - DNA, 20 bp, Artificial Sequence
  sgRNA
  Tas2r123_8
ccagaatcagtacaaatgag

SEQ ID NO: 59748 - DNA, 20 bp, Artificial Sequence
  sgRNA
  Tas2r123_9
tcagaaatgctttcagcaat

SEQ ID NO: 59749 - DNA, 20 bp, Artificial Sequence
  sgRNA
  Tas2r123_10
gttggtgattaagaaaacat

SEQ ID NO: 59750 - DNA, 20 bp, Artificial Sequence
  sgRNA
  Tas2r123_11
cgttactatttccacataca

SEQ ID NO: 59751 - DNA, 20 bp, Artificial Sequence
  sgRNA
  Tas2r123_12
tgagaaaataaaagacaccg

SEQ ID NO: 59752 - DNA, 20 bp, Artificial Sequence
  sgRNA
  Tas2r123_13
cttgtatgtggaaatagtaa

SEQ ID NO: 59753 - DNA, 20 bp, Artificial Sequence
  sgRNA
  Tas2r123_14
atctggcttactacatgcct

SEQ ID NO: 59754 - DNA, 20 bp, Artificial Sequence
  sgRNA
  Tas2r123_15
gttggagaataagaaagtac

SEQ ID NO: 59755 - DNA, 20 bp, Artificial Sequence
  sgRNA
  Tas2r123_16
tggtgtccatatctttggac

SEQ ID NO: 59756 - DNA, 20 bp, Artificial Sequence
  sgRNA
  Tas2r123_17
gccatagtactgacatctct

SEQ ID NO: 59757 - DNA, 20 bp, Artificial Sequence
  sgRNA
  Tas2r123_18
ttgtatgtggaaatagtaac

SEQ ID NO: 59758 - DNA, 20 bp, Artificial Sequence
  sgRNA
  Tas2r123_19
tgctgtgcccacatttgcct

SEQ ID NO: 59759 - DNA, 20 bp, Artificial Sequence
  sgRNA
  Tas2r123_20
actgacatctctaggttgtt

SEQ ID NO: 59760 - DNA, 20 bp, Artificial Sequence
  sgRNA
  Tas2r125_1
ttagaataagcaataacacc

SEQ ID NO: 59761 - DNA, 20 bp, Artificial Sequence
  sgRNA
  Tas2r125_2
attggtgaacatcatagact

SEQ ID NO: 59762 - DNA, 20 bp, Artificial Sequence
  sgRNA
  Tas2r125_3
tctctaggatttatctgctg

SEQ ID NO: 59763 - DNA, 20 bp, Artificial Sequence
  sgRNA
  Tas2r125_4
tgaacatgcatattgatatc

SEQ ID NO: 59764 - DNA, 20 bp, Artificial Sequence
  sgRNA
  Tas2r125_5
gcctttagcatagtattgca

SEQ ID NO: 59765 - DNA, 20 bp, Artificial Sequence
  sgRNA
  Tas2r125_6
ttacaattgtggcataaaac

SEQ ID NO: 59766 - DNA, 20 bp, Artificial Sequence
  sgRNA
  Tas2r125_7
acatataaaggccttgcaca

SEQ ID NO: 59767 - DNA, 20 bp, Artificial Sequence
  sgRNA
  Tas2r125_8
gttattctcttgagacccag

SEQ ID NO: 59768 - DNA, 20 bp, Artificial Sequence
  sgRNA
  Tas2r125_9
tgagaagcagaaaagccaac

SEQ ID NO: 59769 - DNA, 20 bp, Artificial Sequence
  sgRNA
  Tas2r125_10
actggatccagatattaaaa

SEQ ID NO: 59770 - DNA, 20 bp, Artificial Sequence
  sgRNA
  Tas2r125_11
tgcttctcatcttctccctg

SEQ ID NO: 59771 - DNA, 20 bp, Artificial Sequence
  sgRNA
  Tas2r125_12
tgtgcaagtccaaagatgta

SEQ ID NO: 59772 - DNA, 20 bp, Artificial Sequence
  sgRNA
  Tas2r125_13
ttctgagaaacagccagctg

SEQ ID NO: 59773 - DNA, 20 bp, Artificial Sequence
  sgRNA
  Tas2r125_14
ttgatctgacactaaaagaa

SEQ ID NO: 59774 - DNA, 20 bp, Artificial Sequence
  sgRNA
  Tas2r125_15
gtattgccatagatatctta

SEQ ID NO: 59775 - DNA, 20 bp, Artificial Sequence
  sgRNA
  Tas2r125_16
cttaaggtggagatttaaga

SEQ ID NO: 59776 - DNA, 20 bp, Artificial Sequence
  sgRNA
  Tas2r125_17
gctggctgtttctcagaatc

SEQ ID NO: 59777 - DNA, 20 bp, Artificial Sequence
  sgRNA
  Tas2r125_18
gctgaggcaggcatctctgt

SEQ ID NO: 59778 - DNA, 20 bp, Artificial Sequence
  sgRNA
  Tas2r125_19
cattggtgaacatcatagac

SEQ ID NO: 59779 - DNA, 20 bp, Artificial Sequence
  sgRNA
  Tas2r125_20
tcagtaaaatatttaaaagc

SEQ ID NO: 59780 - DNA, 20 bp, Artificial Sequence
  sgRNA
  Tas2r129_1
aaagatgagaattaaccagg

SEQ ID NO: 59781 - DNA, 20 bp, Artificial Sequence
  sgRNA
  Tas2r129_2
tacgctatacacacacgtgt

SEQ ID NO: 59782 - DNA, 20 bp, Artificial Sequence
  sgRNA
  Tas2r129_3
ctctggtgaactgcatacac

SEQ ID NO: 59783 - DNA, 20 bp, Artificial Sequence
  sgRNA
  Tas2r129_4
cttcttgtaatgtctccaca

SEQ ID NO: 59784 - DNA, 20 bp, Artificial Sequence
  sgRNA
  Tas2r129_5
gcaaagtccctgaaaccacc

SEQ ID NO: 59785 - DNA, 20 bp, Artificial Sequence
  sgRNA
  Tas2r129_6
gtaattgtggaaataataat

SEQ ID NO: 59786 - DNA, 20 bp, Artificial Sequence
  sgRNA
  Tas2r129_7
gtagagacacaaacctgaga

SEQ ID NO: 59787 - DNA, 20 bp, Artificial Sequence
  sgRNA
  Tas2r129_8
catcagagtcttgcaaacca

SEQ ID NO: 59788 - DNA, 20 bp, Artificial Sequence
  sgRNA
  Tas2r129_9
gtagattctggagaaagcca

SEQ ID NO: 59789 - DNA, 20 bp, Artificial Sequence
  sgRNA
  Tas2r129_10
cagtgaatactgttaaaaga

SEQ ID NO: 59790 - DNA, 20 bp, Artificial Sequence
  sgRNA
  Tas2r129_11
aatggcacagagtaggacat

SEQ ID NO: 59791 - DNA, 20 bp, Artificial Sequence
  sgRNA
  Tas2r129_12
cgtgttggtaactagaagag

SEQ ID NO: 59792 - DNA, 20 bp, Artificial Sequence
  sgRNA
  Tas2r129_13
gagtaggacataggtgacca

SEQ ID NO: 59793 - DNA, 20 bp, Artificial Sequence
  sgRNA
  Tas2r129_14
ggtttgcaagactctgatgt

SEQ ID NO: 59794 - DNA, 20 bp, Artificial Sequence
  sgRNA
  Tas2r129_15
tgaagaacattctttacgtt

SEQ ID NO: 59795 - DNA, 20 bp, Artificial Sequence
  sgRNA
  Tas2r129_16
gcagagtgtttagaaacaag

SEQ ID NO: 59796 - DNA, 20 bp, Artificial Sequence
  sgRNA
  Tas2r129_17
ctctgatgtgggcatctgca

SEQ ID NO: 59797 - DNA, 20 bp, Artificial Sequence
  sgRNA
  Tas2r129_18
gatgatctgcaatttatgtt

SEQ ID NO: 59798 - DNA, 20 bp, Artificial Sequence
  sgRNA
  Tas2r129_19
ctcactcctcaaaatttgca

SEQ ID NO: 59799 - DNA, 20 bp, Artificial Sequence
  sgRNA
  Tas2r129_20
tgtagagacacaaacctgag

SEQ ID NO: 59800 - DNA, 20 bp, Artificial Sequence
  sgRNA
  Tas2r130_1
tgtcaaggtaaatctcaact

SEQ ID NO: 59801 - DNA, 20 bp, Artificial Sequence
  sgRNA
  Tas2r130_2
tggacatggccacacttgag

SEQ ID NO: 59802 - DNA, 20 bp, Artificial Sequence
  sgRNA
  Tas2r130_3
tgaataaatagaaaatgctg

SEQ ID NO: 59803 - DNA, 20 bp, Artificial Sequence
  sgRNA
  Tas2r130_4
ctgttggtgaggccttagta

SEQ ID NO: 59804 - DNA, 20 bp, Artificial Sequence
  sgRNA
  Tas2r130_5
agaccagagacacagaaaag

SEQ ID NO: 59805 - DNA, 20 bp, Artificial Sequence
  sgRNA
  Tas2r130_6
tatccagacacctacaacag

SEQ ID NO: 59806 - DNA, 20 bp, Artificial Sequence
  sgRNA
  Tas2r130_7
ctgcctggtgtgtctccaca

SEQ ID NO: 59807 - DNA, 20 bp, Artificial Sequence
  sgRNA
  Tas2r130_8
aagtgtccagaagaagtcaa

SEQ ID NO: 59808 - DNA, 20 bp, Artificial Sequence
  sgRNA
  Tas2r130_9
taggcagtagacaacaaaca

SEQ ID NO: 59809 - DNA, 20 bp, Artificial Sequence
  sgRNA
  Tas2r130_10
gttgagatttaccttgacag

SEQ ID NO: 59810 - DNA, 20 bp, Artificial Sequence
  sgRNA
  Tas2r130_11
gactgggaggctaaaacaca

SEQ ID NO: 59811 - DNA, 20 bp, Artificial Sequence
  sgRNA
  Tas2r130_12
actaaaacaagcatctgtga

SEQ ID NO: 59812 - DNA, 20 bp, Artificial Sequence
  sgRNA
  Tas2r130_13
agatacaactcagtgtaaca

SEQ ID NO: 59813 - DNA, 20 bp, Artificial Sequence
  sgRNA
  Tas2r130_14
tggcaaaccagacacttaaa

SEQ ID NO: 59814 - DNA, 20 bp, Artificial Sequence
  sgRNA
  Tas2r130_15
gagaccagagacacagaaaa

SEQ ID NO: 59815 - DNA, 20 bp, Artificial Sequence
  sgRNA
  Tas2r130_16
ccaggatgaggataaatgaa

SEQ ID NO: 59816 - DNA, 20 bp, Artificial Sequence
  sgRNA
  Tas2r130_17
attcatttatcctcatcctg

SEQ ID NO: 59817 - DNA, 20 bp, Artificial Sequence
  sgRNA
  Tas2r130_18
attgcactggtaaacttcat

SEQ ID NO: 59818 - DNA, 20 bp, Artificial Sequence
  sgRNA
  Tas2r130_19
aggtggctatgagaaaggct

SEQ ID NO: 59819 - DNA, 20 bp, Artificial Sequence
  sgRNA
  Tas2r130_20
tgagaggattaaatcaatag

SEQ ID NO: 59820 - DNA, 20 bp, Artificial Sequence
  sgRNA
  Tas2r136_1
agctcaagtgtgtttcatgt

SEQ ID NO: 59821 - DNA, 20 bp, Artificial Sequence
  sgRNA
  Tas2r136_2
gacaccagggcaacttgact

SEQ ID NO: 59822 - DNA, 20 bp, Artificial Sequence
  sgRNA
  Tas2r136_3
aagccatgtattaaaatggt

SEQ ID NO: 59823 - DNA, 20 bp, Artificial Sequence
  sgRNA
  Tas2r136_4
atggttaccattataagatt

SEQ ID NO: 59824 - DNA, 20 bp, Artificial Sequence
  sgRNA
  Tas2r136_5
tgagaattctatcagctaag

SEQ ID NO: 59825 - DNA, 20 bp, Artificial Sequence
  sgRNA
  Tas2r136_6
gattagcaacagaataaaca

SEQ ID NO: 59826 - DNA, 20 bp, Artificial Sequence
  sgRNA
  Tas2r136_7
gggaaacaagaggatcaaac

SEQ ID NO: 59827 - DNA, 20 bp, Artificial Sequence
  sgRNA
  Tas2r136_8
cataaagcctcattgtccta

SEQ ID NO: 59828 - DNA, 20 bp, Artificial Sequence
  sgRNA
  Tas2r136_9
tcactgttctggctatcttc

SEQ ID NO: 59829 - DNA, 20 bp, Artificial Sequence
  sgRNA
  Tas2r136_10
ctttatggaaaaggatccca

SEQ ID NO: 59830 - DNA, 20 bp, Artificial Sequence
  sgRNA
  Tas2r136_11
acacaagcaaatggacacca

SEQ ID NO: 59831 - DNA, 20 bp, Artificial Sequence
  sgRNA
  Tas2r136_12
gttctctgtgtaaacacctt

SEQ ID NO: 59832 - DNA, 20 bp, Artificial Sequence
  sgRNA
  Tas2r136_13
tcttgctatggggaaacaag

SEQ ID NO: 59833 - DNA, 20 bp, Artificial Sequence
  sgRNA
  Tas2r136_14
tcttcccagtcaagttgccc

SEQ ID NO: 59834 - DNA, 20 bp, Artificial Sequence
  sgRNA
  Tas2r136_15
acaggcctttgtgttggcaa

SEQ ID NO: 59835 - DNA, 20 bp, Artificial Sequence
  sgRNA
  Tas2r136_16
ctgaaccattgccaacacaa

SEQ ID NO: 59836 - DNA, 20 bp, Artificial Sequence
  sgRNA
  Tas2r136_17
agaatgtcttgaaggataca

SEQ ID NO: 59837 - DNA, 20 bp, Artificial Sequence
  sgRNA
  Tas2r136_18
gatcaaacaggcctttgtgt

SEQ ID NO: 59838 - DNA, 20 bp, Artificial Sequence
  sgRNA
  Tas2r136_19
tgtgagacaacacaagcaaa

SEQ ID NO: 59839 - DNA, 20 bp, Artificial Sequence
  sgRNA
  Tas2r136_20
gtaaacaccttaggacaatg

SEQ ID NO: 59840 - DNA, 20 bp, Artificial Sequence
  sgRNA
  Tas2r137_1
atacatcagactgaagcgac

SEQ ID NO: 59841 - DNA, 20 bp, Artificial Sequence
  sgRNA
  Tas2r137_2
tgagccagaggaatgagggg

SEQ ID NO: 59842 - DNA, 20 bp, Artificial Sequence
  sgRNA
  Tas2r137_3
cttaccagactcatgactca

SEQ ID NO: 59843 - DNA, 20 bp, Artificial Sequence
  sgRNA
  Tas2r137_4
taacttcatcattaccagct

SEQ ID NO: 59844 - DNA, 20 bp, Artificial Sequence
  sgRNA
  Tas2r137_5
atatgtttggattcattgaa

SEQ ID NO: 59845 - DNA, 20 bp, Artificial Sequence
  sgRNA
  Tas2r137_6
agaacaagcaaggatcaggg

SEQ ID NO: 59846 - DNA, 20 bp, Artificial Sequence
  sgRNA
  Tas2r137_7
ggtttctggtaggaaacgac

SEQ ID NO: 59847 - DNA, 20 bp, Artificial Sequence
  sgRNA
  Tas2r137_8
gtcgtttcctaccagaaacc

SEQ ID NO: 59848 - DNA, 20 bp, Artificial Sequence
  sgRNA
  Tas2r137_9
tcagatgaccacactcacat

SEQ ID NO: 59849 - DNA, 20 bp, Artificial Sequence
  sgRNA
  Tas2r137_10
agataagccaaatactgaag

SEQ ID NO: 59850 - DNA, 20 bp, Artificial Sequence
  sgRNA
  Tas2r137_11
actcagtgatagtcagaacc

SEQ ID NO: 59851 - DNA, 20 bp, Artificial Sequence
  sgRNA
  Tas2r137_12
tggcgatcctggtttctggt

SEQ ID NO: 59852 - DNA, 20 bp, Artificial Sequence
  sgRNA
  Tas2r137_13
tgtcaatcaatagcagctat

SEQ ID NO: 59853 - DNA, 20 bp, Artificial Sequence
  sgRNA
  Tas2r137_14
ttatccctgagtcatgagtc

SEQ ID NO: 59854 - DNA, 20 bp, Artificial Sequence
  sgRNA
  Tas2r137_15
atttgagccagaggaatgag

SEQ ID NO: 59855 - DNA, 20 bp, Artificial Sequence
  sgRNA
  Tas2r137_16
gtgtgtgcttccccagagag

SEQ ID NO: 59856 - DNA, 20 bp, Artificial Sequence
  sgRNA
  Tas2r137_17
gcagtagaaaacactgagac

SEQ ID NO: 59857 - DNA, 20 bp, Artificial Sequence
  sgRNA
  Tas2r137_18
ttctgctgctcctctctctg

SEQ ID NO: 59858 - DNA, 20 bp, Artificial Sequence
  sgRNA
  Tas2r137_19
catttgagccagaggaatga

SEQ ID NO: 59859 - DNA, 20 bp, Artificial Sequence
  sgRNA
  Tas2r137_20
actggatgacaaaatcataa

SEQ ID NO: 59860 - DNA, 20 bp, Artificial Sequence
  sgRNA
  Tas2r138_1
ttgcaatcatccagagagtg

SEQ ID NO: 59861 - DNA, 20 bp, Artificial Sequence
  sgRNA
  Tas2r138_2
tcagccatggagtttgcagt

SEQ ID NO: 59862 - DNA, 20 bp, Artificial Sequence
  sgRNA
  Tas2r138_3
aaaaaagtcccacaaacaaa

SEQ ID NO: 59863 - DNA, 20 bp, Artificial Sequence
  sgRNA
  Tas2r138_4
ggagataaccagcactcccg

SEQ ID NO: 59864 - DNA, 20 bp, Artificial Sequence
  sgRNA
  Tas2r138_5
gatgctatggcacaataagg

SEQ ID NO: 59865 - DNA, 20 bp, Artificial Sequence
  sgRNA
  Tas2r138_6
gattcccactgcaaactcca

SEQ ID NO: 59866 - DNA, 20 bp, Artificial Sequence
  sgRNA
  Tas2r138_7
ggggagtgatgatttgtata

SEQ ID NO: 59867 - DNA, 20 bp, Artificial Sequence
  sgRNA
  Tas2r138_8
gcgatgtcacagttgttcaa

SEQ ID NO: 59868 - DNA, 20 bp, Artificial Sequence
  sgRNA
  Tas2r138_9
gcttagcattgcctgatatc

SEQ ID NO: 59869 - DNA, 20 bp, Artificial Sequence
  sgRNA
  Tas2r138_10
agcattgcctgatatcagga

SEQ ID NO: 59870 - DNA, 20 bp, Artificial Sequence
  sgRNA
  Tas2r138_11
ctagctttcctggtttcctc

SEQ ID NO: 59871 - DNA, 20 bp, Artificial Sequence
  sgRNA
  Tas2r138_12
ggacaatcttggagcagtag

SEQ ID NO: 59872 - DNA, 20 bp, Artificial Sequence
  sgRNA
  Tas2r138_13
aaaccaagtgagcctctggc

SEQ ID NO: 59873 - DNA, 20 bp, Artificial Sequence
  sgRNA
  Tas2r138_14
tgatgctatggcacaataag

SEQ ID NO: 59874 - DNA, 20 bp, Artificial Sequence
  sgRNA
  Tas2r138_15
aggcaatgctaagctgagga

SEQ ID NO: 59875 - DNA, 20 bp, Artificial Sequence
  sgRNA
  Tas2r138_16
tcataggacacagttaagac

SEQ ID NO: 59876 - DNA, 20 bp, Artificial Sequence
  sgRNA
  Tas2r138_17
ctgatgctatggcacaataa

SEQ ID NO: 59877 - DNA, 20 bp, Artificial Sequence
  sgRNA
  Tas2r138_18
gagtgctggttatctccctg

SEQ ID NO: 59878 - DNA, 20 bp, Artificial Sequence
  sgRNA
  Tas2r138_19
ttcagccatggagtttgcag

SEQ ID NO: 59879 - DNA, 20 bp, Artificial Sequence
  sgRNA
  Tas2r138_20
gtgcagtagagatgtgaccg

SEQ ID NO: 59880 - DNA, 20 bp, Artificial Sequence
  sgRNA
  Tas2r139_1
ccataggtatcattgcaagt

SEQ ID NO: 59881 - DNA, 20 bp, Artificial Sequence
  sgRNA
  Tas2r139_2
gttgcgacgaacattgtcaa

SEQ ID NO: 59882 - DNA, 20 bp, Artificial Sequence
  sgRNA
  Tas2r139_3
cactttagtttgaagaacag

SEQ ID NO: 59883 - DNA, 20 bp, Artificial Sequence
  sgRNA
  Tas2r139_4
ttacgttgttgagaccaatg

SEQ ID NO: 59884 - DNA, 20 bp, Artificial Sequence
  sgRNA
  Tas2r139_5
cgacgaacattgtcaaagga

SEQ ID NO: 59885 - DNA, 20 bp, Artificial Sequence
  sgRNA
  Tas2r139_6
tccatgttcttcttaatcca

SEQ ID NO: 59886 - DNA, 20 bp, Artificial Sequence
  sgRNA
  Tas2r139_7
gttaacatcaaaatagacaa

SEQ ID NO: 59887 - DNA, 20 bp, Artificial Sequence
  sgRNA
  Tas2r139_8
gtgcttgctgaagaacatgc

SEQ ID NO: 59888 - DNA, 20 bp, Artificial Sequence
  sgRNA
  Tas2r139_9
tctgaattagtaaaactgaa

SEQ ID NO: 59889 - DNA, 20 bp, Artificial Sequence
  sgRNA
  Tas2r139_10
gcatatgagcctctatgcag

SEQ ID NO: 59890 - DNA, 20 bp, Artificial Sequence
  sgRNA
  Tas2r139_11
agtaaaactgaatggccagc

SEQ ID NO: 59891 - DNA, 20 bp, Artificial Sequence
  sgRNA
  Tas2r139_12
gatacctatggtgcactcag

SEQ ID NO: 59892 - DNA, 20 bp, Artificial Sequence
  sgRNA
  Tas2r139_13
gttctgcctgtctacccagc

SEQ ID NO: 59893 - DNA, 20 bp, Artificial Sequence
  sgRNA
  Tas2r139_14
gcgacgaacattgtcaaagg

SEQ ID NO: 59894 - DNA, 20 bp, Artificial Sequence
  sgRNA
  Tas2r139_15
tcttgtttccagtagttgct

SEQ ID NO: 59895 - DNA, 20 bp, Artificial Sequence
  sgRNA
  Tas2r139_16
ctccagaaacccctgcatag

SEQ ID NO: 59896 - DNA, 20 bp, Artificial Sequence
  sgRNA
  Tas2r139_17
gtaaaactgaatggccagct

SEQ ID NO: 59897 - DNA, 20 bp, Artificial Sequence
  sgRNA
  Tas2r139_18
ttactaattcagaacaaccc

SEQ ID NO: 59898 - DNA, 20 bp, Artificial Sequence
  sgRNA
  Tas2r139_19
actgagagccacagaagcca

SEQ ID NO: 59899 - DNA, 20 bp, Artificial Sequence
  sgRNA
  Tas2r139_20
ccactttagtttgaagaaca

SEQ ID NO: 59900 - DNA, 20 bp, Artificial Sequence
  sgRNA
  Tas2r140_1
tatgaatgtgaatatagtgt

SEQ ID NO: 59901 - DNA, 20 bp, Artificial Sequence
  sgRNA
  Tas2r140_2
ctaaaacgtttacaaacaag

SEQ ID NO: 59902 - DNA, 20 bp, Artificial Sequence
  sgRNA
  Tas2r140_3
taggtgtagaaatcattata

SEQ ID NO: 59903 - DNA, 20 bp, Artificial Sequence
  sgRNA
  Tas2r140_4
tgaccacacaaaagcaagtc

SEQ ID NO: 59904 - DNA, 20 bp, Artificial Sequence
  sgRNA
  Tas2r140_5
ccagaattaggacacaagag

SEQ ID NO: 59905 - DNA, 20 bp, Artificial Sequence
  sgRNA
  Tas2r140_6
attgtcagcgtcacactgaa

SEQ ID NO: 59906 - DNA, 20 bp, Artificial Sequence
  sgRNA
  Tas2r140_7
aatggtgtataataagagaa

SEQ ID NO: 59907 - DNA, 20 bp, Artificial Sequence
  sgRNA
  Tas2r140_8
aggacacaagagtggcccga

SEQ ID NO: 59908 - DNA, 20 bp, Artificial Sequence
  sgRNA
  Tas2r140_9
ttaggtgtagaaatcattat

SEQ ID NO: 59909 - DNA, 20 bp, Artificial Sequence
  sgRNA
  Tas2r140_10
ggacttcagccaccatactg

SEQ ID NO: 59910 - DNA, 20 bp, Artificial Sequence
  sgRNA
  Tas2r140_11
tgtacattattaatcatctt

SEQ ID NO: 59911 - DNA, 20 bp, Artificial Sequence
  sgRNA
  Tas2r140_12
tattaaggccctgcaaatga

SEQ ID NO: 59912 - DNA, 20 bp, Artificial Sequence
  sgRNA
  Tas2r140_13
catttgcagggccttaatat

SEQ ID NO: 59913 - DNA, 20 bp, Artificial Sequence
  sgRNA
  Tas2r140_14
gttatctgaatgagaactgt

SEQ ID NO: 59914 - DNA, 20 bp, Artificial Sequence
  sgRNA
  Tas2r140_15
tttaatgctgcagaactccc

SEQ ID NO: 59915 - DNA, 20 bp, Artificial Sequence
  sgRNA
  Tas2r140_16
gacaagtgccagaaagaaaa

SEQ ID NO: 59916 - DNA, 20 bp, Artificial Sequence
  sgRNA
  Tas2r140_17
gagaagaaagatctccttag

SEQ ID NO: 59917 - DNA, 20 bp, Artificial Sequence
  sgRNA
  Tas2r140_18
agtgaatatctgatccacta

SEQ ID NO: 59918 - DNA, 20 bp, Artificial Sequence
  sgRNA
  Tas2r140_19
aaaggtgaccatcatttgca

SEQ ID NO: 59919 - DNA, 20 bp, Artificial Sequence
  sgRNA
  Tas2r140_20
tgatcaatcatttcaatatt

SEQ ID NO: 59920 - DNA, 20 bp, Artificial Sequence
  sgRNA
  Tbxa2r_1
gacgtgccatcgcgtcgcca

SEQ ID NO: 59921 - DNA, 20 bp, Artificial Sequence
  sgRNA
  Tbxa2r_2
ctgacactcgggacacagcg

SEQ ID NO: 59922 - DNA, 20 bp, Artificial Sequence
  sgRNA
  Tbxa2r_3
agtggctcgccagtccaaca

SEQ ID NO: 59923 - DNA, 20 bp, Artificial Sequence
  sgRNA
  Tbxa2r_4
agcgcttcgtgggcatcaca

SEQ ID NO: 59924 - DNA, 20 bp, Artificial Sequence
  sgRNA
  Tbxa2r_5
ccgcctgtgctacttcatgg

SEQ ID NO: 59925 - DNA, 20 bp, Artificial Sequence
  sgRNA
  Tbxa2r_6
tcaggaagcaccaagagccg

SEQ ID NO: 59926 - DNA, 20 bp, Artificial Sequence
  sgRNA
  Tbxa2r_7
gggctcatattcgcactcct

SEQ ID NO: 59927 - DNA, 20 bp, Artificial Sequence
  sgRNA
  Tbxa2r_8
gcgaaagcaggcccccagcg

SEQ ID NO: 59928 - DNA, 20 bp, Artificial Sequence
  sgRNA
  Tbxa2r_9
gggtctatatcctctttcgc

SEQ ID NO: 59929 - DNA, 20 bp, Artificial Sequence
  sgRNA
  Tbxa2r_10
gatgcccacgaagcgctcag

SEQ ID NO: 59930 - DNA, 20 bp, Artificial Sequence
  sgRNA
  Tbxa2r_11
ccgggtctaccacacgcgcg

SEQ ID NO: 59931 - DNA, 20 bp, Artificial Sequence
  sgRNA
  Tbxa2r_12
gcgaaagaggatatagaccc

SEQ ID NO: 59932 - DNA, 20 bp, Artificial Sequence
  sgRNA
  Tbxa2r_13
ttgttctcaccgacttcctg

SEQ ID NO: 59933 - DNA, 20 bp, Artificial Sequence
  sgRNA
  Tbxa2r_14
gcagagtgtggccacactaa

SEQ ID NO: 59934 - DNA, 20 bp, Artificial Sequence
  sgRNA
  Tbxa2r_15
agcgaaccatggcgacgcga

SEQ ID NO: 59935 - DNA, 20 bp, Artificial Sequence
  sgRNA
  Tbxa2r_16
tgaaccgcggatgcaggcgc

SEQ ID NO: 59936 - DNA, 20 bp, Artificial Sequence
  sgRNA
  Tbxa2r_17
ctacccccatgaagtagcac

SEQ ID NO: 59937 - DNA, 20 bp, Artificial Sequence
  sgRNA
  Tbxa2r_18
gctgctcatctacctgcgtg

SEQ ID NO: 59938 - DNA, 20 bp, Artificial Sequence
  sgRNA
  Tbxa2r_19
gcccccagcgaggtgccatt

SEQ ID NO: 59939 - DNA, 20 bp, Artificial Sequence
  sgRNA
  Tbxa2r_20
gagatgatggttcagctcgt

SEQ ID NO: 59940 - DNA, 20 bp, Artificial Sequence
  sgRNA
  Tcirg1_1
acacaagtgcctcatcgcgg

SEQ ID NO: 59941 - DNA, 20 bp, Artificial Sequence
  sgRNA
  Tcirg1_2
tctcccgaaagctggcaatg

SEQ ID NO: 59942 - DNA, 20 bp, Artificial Sequence
  sgRNA
  Tcirg1_3
cagccacactccaacctgag

SEQ ID NO: 59943 - DNA, 20 bp, Artificial Sequence
  sgRNA
  Tcirg1_4
cgctacagggaagttaaccc

SEQ ID NO: 59944 - DNA, 20 bp, Artificial Sequence
  sgRNA
  Tcirg1_5
ggtagacgtccggcgctgcg

SEQ ID NO: 59945 - DNA, 20 bp, Artificial Sequence
  sgRNA
  Tcirg1_6
gtgcagccttcacagctgga

SEQ ID NO: 59946 - DNA, 20 bp, Artificial Sequence
  sgRNA
  Tcirg1_7
ggtctccagcagtagccggt

SEQ ID NO: 59947 - DNA, 20 bp, Artificial Sequence
  sgRNA
  Tcirg1_8
gatgctgaggaacaccccaa

SEQ ID NO: 59948 - DNA, 20 bp, Artificial Sequence
  sgRNA
  Tcirg1_9
catgggccgagagatcggcg

SEQ ID NO: 59949 - DNA, 20 bp, Artificial Sequence
  sgRNA
  Tcirg1_10
gcagccacactccaacctga

SEQ ID NO: 59950 - DNA, 20 bp, Artificial Sequence
  sgRNA
  Tcirg1_11
gcccagcaacaggataggaa

SEQ ID NO: 59951 - DNA, 20 bp, Artificial Sequence
  sgRNA
  Tcirg1_12
ggatgttcgtggcaatcagc

SEQ ID NO: 59952 - DNA, 20 bp, Artificial Sequence
  sgRNA
  Tcirg1_13
ggtgcagatccacaagatga

SEQ ID NO: 59953 - DNA, 20 bp, Artificial Sequence
  sgRNA
  Tcirg1_14
agacctgctgcgcatccagg

SEQ ID NO: 59954 - DNA, 20 bp, Artificial Sequence
  sgRNA
  Tcirg1_15
ggaagtggtacagtacgtgc

SEQ ID NO: 59955 - DNA, 20 bp, Artificial Sequence
  sgRNA
  Tcirg1_16
tgctggcgcagcaggtacaa

SEQ ID NO: 59956 - DNA, 20 bp, Artificial Sequence
  sgRNA
  Tcirg1_17
gatctggcagaccttctttg

SEQ ID NO: 59957 - DNA, 20 bp, Artificial Sequence
  sgRNA
  Tcirg1_18
gcaccagctgcggcttcact

SEQ ID NO: 59958 - DNA, 20 bp, Artificial Sequence
  sgRNA
  Tcirg1_19
cagccttcctgcatgccctg

SEQ ID NO: 59959 - DNA, 20 bp, Artificial Sequence
  sgRNA
  Tcirg1_20
cgatacctactcctgctcat

SEQ ID NO: 59960 - DNA, 20 bp, Artificial Sequence
  sgRNA
  Tctn3_1
accctatagaatagtactgg

SEQ ID NO: 59961 - DNA, 20 bp, Artificial Sequence
  sgRNA
  Tctn3_2
gcagctcaccttacactacc

SEQ ID NO: 59962 - DNA, 20 bp, Artificial Sequence
  sgRNA
  Tctn3_3
gtctacgagatagagaccaa

SEQ ID NO: 59963 - DNA, 20 bp, Artificial Sequence
  sgRNA
  Tctn3_4
ctaagagtggcttcccagtg

SEQ ID NO: 59964 - DNA, 20 bp, Artificial Sequence
  sgRNA
  Tctn3_5
atgaccctgttgcagagcga

SEQ ID NO: 59965 - DNA, 20 bp, Artificial Sequence
  sgRNA
  Tctn3_6
tctacgagatagagaccaat

SEQ ID NO: 59966 - DNA, 20 bp, Artificial Sequence
  sgRNA
  Tctn3_7
gccgccagtactattctata

SEQ ID NO: 59967 - DNA, 20 bp, Artificial Sequence
  sgRNA
  Tctn3_8
gaggtttatcagactctgca

SEQ ID NO: 59968 - DNA, 20 bp, Artificial Sequence
  sgRNA
  Tctn3_9
gatgaccctgttgcagagcg

SEQ ID NO: 59969 - DNA, 20 bp, Artificial Sequence
  sgRNA
  Tctn3_10
ggactctcagacgaatccgg

SEQ ID NO: 59970 - DNA, 20 bp, Artificial Sequence
  sgRNA
  Tctn3_11
ccaacctgactgtcaagcca

SEQ ID NO: 59971 - DNA, 20 bp, Artificial Sequence
  sgRNA
  Tctn3_12
acgggcatcgatagagtcca

SEQ ID NO: 59972 - DNA, 20 bp, Artificial Sequence
  sgRNA
  Tctn3_13
tgtttccagccaacagagga

SEQ ID NO: 59973 - DNA, 20 bp, Artificial Sequence
  sgRNA
  Tctn3_14
tctgaactctctcagaggga

SEQ ID NO: 59974 - DNA, 20 bp, Artificial Sequence
  sgRNA
  Tctn3_15
attaccctcgctctgcaaca

SEQ ID NO: 59975 - DNA, 20 bp, Artificial Sequence
  sgRNA
  Tctn3_16
attctgggttgatccctagg

SEQ ID NO: 59976 - DNA, 20 bp, Artificial Sequence
  sgRNA
  Tctn3_17
actggagtccgtgaaaactc

SEQ ID NO: 59977 - DNA, 20 bp, Artificial Sequence
  sgRNA
  Tctn3_18
gtccaagtagtaagacacac

SEQ ID NO: 59978 - DNA, 20 bp, Artificial Sequence
  sgRNA
  Tctn3_19
gataaacctcctcctgcaag

SEQ ID NO: 59979 - DNA, 20 bp, Artificial Sequence
  sgRNA
  Tctn3_20
gggatcaacccagaatagac

SEQ ID NO: 59980 - DNA, 20 bp, Artificial Sequence
  sgRNA
  Tdgf1_1
gggtccaaattcaaacgcac

SEQ ID NO: 59981 - DNA, 20 bp, Artificial Sequence
  sgRNA
  Tdgf1_2
cagttgcgtccatagaagga

SEQ ID NO: 59982 - DNA, 20 bp, Artificial Sequence
  sgRNA
  Tdgf1_3
ctgttctgtatccccacgga

SEQ ID NO: 59983 - DNA, 20 bp, Artificial Sequence
  sgRNA
  Tdgf1_4
aagaacctgccgtacgcgat

SEQ ID NO: 59984 - DNA, 20 bp, Artificial Sequence
  sgRNA
  Tdgf1_5
gcaaggtctctcccagcaac

SEQ ID NO: 59985 - DNA, 20 bp, Artificial Sequence
  sgRNA
  Tdgf1_6
ttgaatttggacccgttgct

SEQ ID NO: 59986 - DNA, 20 bp, Artificial Sequence
  sgRNA
  Tdgf1_7
gccacaagcaaaaccacact

SEQ ID NO: 59987 - DNA, 20 bp, Artificial Sequence
  sgRNA
  Tdgf1_8
ataaaagtggtcgtcacaga

SEQ ID NO: 59988 - DNA, 20 bp, Artificial Sequence
  sgRNA
  Tdgf1_9
ggcaaggtctctcccagcaa

SEQ ID NO: 59989 - DNA, 20 bp, Artificial Sequence
  sgRNA
  Tdgf1_10
tccagtttgtgccttccgtg

SEQ ID NO: 59990 - DNA, 20 bp, Artificial Sequence
  sgRNA
  Tdgf1_11
cggcgtttgacacggagtcc

SEQ ID NO: 59991 - DNA, 20 bp, Artificial Sequence
  sgRNA
  Tdgf1_12
ttccagtttgtgccttccgt

SEQ ID NO: 59992 - DNA, 20 bp, Artificial Sequence
  sgRNA
  Tdgf1_13
gtcacagacggcgtttgaca

SEQ ID NO: 59993 - DNA, 20 bp, Artificial Sequence
  sgRNA
  Tdgf1_14
gaccaggacctcaaagcatc

SEQ ID NO: 59994 - DNA, 20 bp, Artificial Sequence
  sgRNA
  Tdgf1_15
acggagtcccggatgctttg

SEQ ID NO: 59995 - DNA, 20 bp, Artificial Sequence
  sgRNA
  Tdgf1_16
tttccagtttgtgccttccg

SEQ ID NO: 59996 - DNA, 20 bp, Artificial Sequence
  sgRNA
  Tdgf1_17
tgatggtcacgtgatggacc

SEQ ID NO: 59997 - DNA, 20 bp, Artificial Sequence
  sgRNA
  Tdgf1_18
atttccagtgcgtttgaatt

SEQ ID NO: 59998 - DNA, 20 bp, Artificial Sequence
  sgRNA
  Tdgf1_19
tcccggatgctttgaggtcc

SEQ ID NO: 59999 - DNA, 20 bp, Artificial Sequence
  sgRNA
  Tdgf1_20
aaattcaaacgcactggaaa

SEQ ID NO: 60000 - DNA, 20 bp, Artificial Sequence
  sgRNA
  Tecta_1
ggaaggttgcgagtgcaacg

SEQ ID NO: 60001 - DNA, 20 bp, Artificial Sequence
  sgRNA
  Tecta_2
tgggttcgcacacctcgtag

SEQ ID NO: 60002 - DNA, 20 bp, Artificial Sequence
  sgRNA
  Tecta_3
gtttgactcctgtatcgatg

SEQ ID NO: 60003 - DNA, 20 bp, Artificial Sequence
  sgRNA
  Tecta_4
ggtcgttgatgataccacac

SEQ ID NO: 60004 - DNA, 20 bp, Artificial Sequence
  sgRNA
  Tecta_5
gcatctcaaggtcatcatcg

SEQ ID NO: 60005 - DNA, 20 bp, Artificial Sequence
  sgRNA
  Tecta_6
ggacgtagcctgcatcacac

SEQ ID NO: 60006 - DNA, 20 bp, Artificial Sequence
  sgRNA
  Tecta_7
acgactacgtgaccttgcgg

SEQ ID NO: 60007 - DNA, 20 bp, Artificial Sequence
  sgRNA
  Tecta_8
acacacctccccactccggc

SEQ ID NO: 60008 - DNA, 20 bp, Artificial Sequence
  sgRNA
  Tecta_9
gagtcctttcccctgacgga

SEQ ID NO: 60009 - DNA, 20 bp, Artificial Sequence
  sgRNA
  Tecta_10
tgaatctccaacctccccga

SEQ ID NO: 60010 - DNA, 20 bp, Artificial Sequence
  sgRNA
  Tecta_11
acagctgtgtacaaaagccg

SEQ ID NO: 60011 - DNA, 20 bp, Artificial Sequence
  sgRNA
  Tecta_12
gctgtggaggacggttacca

SEQ ID NO: 60012 - DNA, 20 bp, Artificial Sequence
  sgRNA
  Tecta_13
actcgcccatggtatagtag

SEQ ID NO: 60013 - DNA, 20 bp, Artificial Sequence
  sgRNA
  Tecta_14
agctctccaagaacaccgcc

SEQ ID NO: 60014 - DNA, 20 bp, Artificial Sequence
  sgRNA
  Tecta_15
ggtgtcttccgcacgttcga

SEQ ID NO: 60015 - DNA, 20 bp, Artificial Sequence
  sgRNA
  Tecta_16
ggacgtgtagttcctccagc

SEQ ID NO: 60016 - DNA, 20 bp, Artificial Sequence
  sgRNA
  Tecta_17
gaccttgcgggggaaacccg

SEQ ID NO: 60017 - DNA, 20 bp, Artificial Sequence
  sgRNA
  Tecta_18
atacaggaagcatcagtacg

SEQ ID NO: 60018 - DNA, 20 bp, Artificial Sequence
  sgRNA
  Tecta_19
ttcccatgacatcatcgacg

SEQ ID NO: 60019 - DNA, 20 bp, Artificial Sequence
  sgRNA
  Tecta_20
agcagattctcatcaacgat

SEQ ID NO: 60020 - DNA, 20 bp, Artificial Sequence
  sgRNA
  Tectb_1
cggggggctgtgttacaacg

SEQ ID NO: 60021 - DNA, 20 bp, Artificial Sequence
  sgRNA
  Tectb_2
cccatccatagggacactcg

SEQ ID NO: 60022 - DNA, 20 bp, Artificial Sequence
  sgRNA
  Tectb_3
tttgcgggagtagaagccaa

SEQ ID NO: 60023 - DNA, 20 bp, Artificial Sequence
  sgRNA
  Tectb_4
cggagtgcatgatttcgctg

SEQ ID NO: 60024 - DNA, 20 bp, Artificial Sequence
  sgRNA
  Tectb_5
tggtgtacttcccatccata

SEQ ID NO: 60025 - DNA, 20 bp, Artificial Sequence
  sgRNA
  Tectb_6
acttcatgtaccccttacag

SEQ ID NO: 60026 - DNA, 20 bp, Artificial Sequence
  sgRNA
  Tectb_7
atgctacgtgaccagacagg

SEQ ID NO: 60027 - DNA, 20 bp, Artificial Sequence
  sgRNA
  Tectb_8
ggtacatgaagtcagccgag

SEQ ID NO: 60028 - DNA, 20 bp, Artificial Sequence
  sgRNA
  Tectb_9
cccgttcttgacgtgaacag

SEQ ID NO: 60029 - DNA, 20 bp, Artificial Sequence
  sgRNA
  Tectb_10
gggtacatgaagtcagccga

SEQ ID NO: 60030 - DNA, 20 bp, Artificial Sequence
  sgRNA
  Tectb_11
cagtggcagctcatcaataa

SEQ ID NO: 60031 - DNA, 20 bp, Artificial Sequence
  sgRNA
  Tectb_12
aaagagggccagcaaaacga

SEQ ID NO: 60032 - DNA, 20 bp, Artificial Sequence
  sgRNA
  Tectb_13
tgagaacggcaaagaccaca

SEQ ID NO: 60033 - DNA, 20 bp, Artificial Sequence
  sgRNA
  Tectb_14
ggaaccggaaggcattgaat

SEQ ID NO: 60034 - DNA, 20 bp, Artificial Sequence
  sgRNA
  Tectb_15
aatcggctcagatctgtttg

SEQ ID NO: 60035 - DNA, 20 bp, Artificial Sequence
  sgRNA
  Tectb_16
gtacaccagctggcactcgg

SEQ ID NO: 60036 - DNA, 20 bp, Artificial Sequence
  sgRNA
  Tectb_17
ggggtacatgaagtcagccg

SEQ ID NO: 60037 - DNA, 20 bp, Artificial Sequence
  sgRNA
  Tectb_18
tcttgggataacaaaacaca

SEQ ID NO: 60038 - DNA, 20 bp, Artificial Sequence
  sgRNA
  Tectb_19
cgaggactgtctcatcggtg

SEQ ID NO: 60039 - DNA, 20 bp, Artificial Sequence
  sgRNA
  Tectb_20
ctgtagaagtggtagatggg

SEQ ID NO: 60040 - DNA, 20 bp, Artificial Sequence
  sgRNA
  Tek_1
ttaactatgaccgtggacag

SEQ ID NO: 60041 - DNA, 20 bp, Artificial Sequence
  sgRNA
  Tek_2
agtacaaggacggctacagt

SEQ ID NO: 60042 - DNA, 20 bp, Artificial Sequence
  sgRNA
  Tek_3
ctatacagatcgtttctcag

SEQ ID NO: 60043 - DNA, 20 bp, Artificial Sequence
  sgRNA
  Tek_4
ctggtccgtagtaaccagat

SEQ ID NO: 60044 - DNA, 20 bp, Artificial Sequence
  sgRNA
  Tek_5
ctagcactctgctcttacgc

SEQ ID NO: 60045 - DNA, 20 bp, Artificial Sequence
  sgRNA
  Tek_6
tctgaaggcacgcatcaaga

SEQ ID NO: 60046 - DNA, 20 bp, Artificial Sequence
  sgRNA
  Tek_7
tctcagcaaaaatatccaca

SEQ ID NO: 60047 - DNA, 20 bp, Artificial Sequence
  sgRNA
  Tek_8
gctattgagtatgccccgca

SEQ ID NO: 60048 - DNA, 20 bp, Artificial Sequence
  sgRNA
  Tek_9
agtaggtagtggccacccag

SEQ ID NO: 60049 - DNA, 20 bp, Artificial Sequence
  sgRNA
  Tek_10
tctaatgagacagtgctgga

SEQ ID NO: 60050 - DNA, 20 bp, Artificial Sequence
  sgRNA
  Tek_11
gtttcggcatcagacacaag

SEQ ID NO: 60051 - DNA, 20 bp, Artificial Sequence
  sgRNA
  Tek_12
gccagagactacataccatg

SEQ ID NO: 60052 - DNA, 20 bp, Artificial Sequence
  sgRNA
  Tek_13
aagtcattccagccgaccca

SEQ ID NO: 60053 - DNA, 20 bp, Artificial Sequence
  sgRNA
  Tek_14
ttagccggcttagttctctg

SEQ ID NO: 60054 - DNA, 20 bp, Artificial Sequence
  sgRNA
  Tek_15
taagttgctcagtagcaccg

SEQ ID NO: 60055 - DNA, 20 bp, Artificial Sequence
  sgRNA
  Tek_16
gcgcacgtcatgccgcagta

SEQ ID NO: 60056 - DNA, 20 bp, Artificial Sequence
  sgRNA
  Tek_17
gagtacacaccagcatcctg

SEQ ID NO: 60057 - DNA, 20 bp, Artificial Sequence
  sgRNA
  Tek_18
gctctatgagaagctacccc

SEQ ID NO: 60058 - DNA, 20 bp, Artificial Sequence
  sgRNA
  Tek_19
tgttcacctcagccttcacc

SEQ ID NO: 60059 - DNA, 20 bp, Artificial Sequence
  sgRNA
  Tek_20
ccatctgcaaagcctctggg

SEQ ID NO: 60060 - DNA, 20 bp, Artificial Sequence
  sgRNA
  Tenm1_1
tcatcgccgaaacagacgag

SEQ ID NO: 60061 - DNA, 20 bp, Artificial Sequence
  sgRNA
  Tenm1_2
accatctggactcacccgat

SEQ ID NO: 60062 - DNA, 20 bp, Artificial Sequence
  sgRNA
  Tenm1_3
aattacataggctagtaaca

SEQ ID NO: 60063 - DNA, 20 bp, Artificial Sequence
  sgRNA
  Tenm1_4
gacattgactcccacaagcg

SEQ ID NO: 60064 - DNA, 20 bp, Artificial Sequence
  sgRNA
  Tenm1_5
gtatgataatatgggccgga

SEQ ID NO: 60065 - DNA, 20 bp, Artificial Sequence
  sgRNA
  Tenm1_6
gtatggaacgactgtcgaag

SEQ ID NO: 60066 - DNA, 20 bp, Artificial Sequence
  sgRNA
  Tenm1_7
tgtactttaatcatgcccac

SEQ ID NO: 60067 - DNA, 20 bp, Artificial Sequence
  sgRNA
  Tenm1_8
gagaccgcatcactagacta

SEQ ID NO: 60068 - DNA, 20 bp, Artificial Sequence
  sgRNA
  Tenm1_9
agaccgggcgacctattctg

SEQ ID NO: 60069 - DNA, 20 bp, Artificial Sequence
  sgRNA
  Tenm1_10
tgaatgacaaaatccagtgg

SEQ ID NO: 60070 - DNA, 20 bp, Artificial Sequence
  sgRNA
  Tenm1_11
ttagctgtgttcagcagtcg

SEQ ID NO: 60071 - DNA, 20 bp, Artificial Sequence
  sgRNA
  Tenm1_12
agaccgcatcactagactag

SEQ ID NO: 60072 - DNA, 20 bp, Artificial Sequence
  sgRNA
  Tenm1_13
gtctggccatctccaacacg

SEQ ID NO: 60073 - DNA, 20 bp, Artificial Sequence
  sgRNA
  Tenm1_14
ggtccaatatgagatcctaa

SEQ ID NO: 60074 - DNA, 20 bp, Artificial Sequence
  sgRNA
  Tenm1_15
atatacgccgggatgcaggt

SEQ ID NO: 60075 - DNA, 20 bp, Artificial Sequence
  sgRNA
  Tenm1_16
aatgatggagatctccccat

SEQ ID NO: 60076 - DNA, 20 bp, Artificial Sequence
  sgRNA
  Tenm1_17
gatgcagagtctgtaacagt

SEQ ID NO: 60077 - DNA, 20 bp, Artificial Sequence
  sgRNA
  Tenm1_18
gctacatagagggtgccatc

SEQ ID NO: 60078 - DNA, 20 bp, Artificial Sequence
  sgRNA
  Tenm1_19
gagtagatgccaatatcaca

SEQ ID NO: 60079 - DNA, 20 bp, Artificial Sequence
  sgRNA
  Tenm1_20
gcagatatccaactgcagca

SEQ ID NO: 60080 - DNA, 20 bp, Artificial Sequence
  sgRNA
  Tenm2_1
gttggcgtacatcacccgca

SEQ ID NO: 60081 - DNA, 20 bp, Artificial Sequence
  sgRNA
  Tenm2_2
tggcaaatgtgaatgccgag

SEQ ID NO: 60082 - DNA, 20 bp, Artificial Sequence
  sgRNA
  Tenm2_3
cttaccaggaaacgatgatg

SEQ ID NO: 60083 - DNA, 20 bp, Artificial Sequence
  sgRNA
  Tenm2_4
ggagcttcacattggtacca

SEQ ID NO: 60084 - DNA, 20 bp, Artificial Sequence
  sgRNA
  Tenm2_5
ctttgtgaagatcggcgccg

SEQ ID NO: 60085 - DNA, 20 bp, Artificial Sequence
  sgRNA
  Tenm2_6
gagataacggagcttcacat

SEQ ID NO: 60086 - DNA, 20 bp, Artificial Sequence
  sgRNA
  Tenm2_7
ttatgaccgaaatatccgaa

SEQ ID NO: 60087 - DNA, 20 bp, Artificial Sequence
  sgRNA
  Tenm2_8
gcctggttatccggtcacgg

SEQ ID NO: 60088 - DNA, 20 bp, Artificial Sequence
  sgRNA
  Tenm2_9
ggtgatgtacgccaacggca

SEQ ID NO: 60089 - DNA, 20 bp, Artificial Sequence
  sgRNA
  Tenm2_10
ggaactcactgaccaatcgg

SEQ ID NO: 60090 - DNA, 20 bp, Artificial Sequence
  sgRNA
  Tenm2_11
atagctccagactttcccgt

SEQ ID NO: 60091 - DNA, 20 bp, Artificial Sequence
  sgRNA
  Tenm2_12
atgtcgcctcagacaacacg

SEQ ID NO: 60092 - DNA, 20 bp, Artificial Sequence
  sgRNA
  Tenm2_13
ctcgtcatacccaaaggtga

SEQ ID NO: 60093 - DNA, 20 bp, Artificial Sequence
  sgRNA
  Tenm2_14
ctcgccgtcctccttagccg

SEQ ID NO: 60094 - DNA, 20 bp, Artificial Sequence
  sgRNA
  Tenm2_15
ggacgggtacaaggttatga

SEQ ID NO: 60095 - DNA, 20 bp, Artificial Sequence
  sgRNA
  Tenm2_16
ccgttcccgtgacagttccg

SEQ ID NO: 60096 - DNA, 20 bp, Artificial Sequence
  sgRNA
  Tenm2_17
gtacacctatgactatgacg

SEQ ID NO: 60097 - DNA, 20 bp, Artificial Sequence
  sgRNA
  Tenm2_18
agactggtcactacgcccgt

SEQ ID NO: 60098 - DNA, 20 bp, Artificial Sequence
  sgRNA
  Tenm2_19
tctcaactgtgagctggcga

SEQ ID NO: 60099 - DNA, 20 bp, Artificial Sequence
  sgRNA
  Tenm2_20
tggtgtataaacggtccctg

SEQ ID NO: 60100 - DNA, 20 bp, Artificial Sequence
  sgRNA
  Tenm3_1
cgactcgtactcgtatccga

SEQ ID NO: 60101 - DNA, 20 bp, Artificial Sequence
  sgRNA
  Tenm3_2
ggtttgtaaccaccccagtg

SEQ ID NO: 60102 - DNA, 20 bp, Artificial Sequence
  sgRNA
  Tenm3_3
tcacggggtgtgtatccatg

SEQ ID NO: 60103 - DNA, 20 bp, Artificial Sequence
  sgRNA
  Tenm3_4
ctatcggccgaaatcactca

SEQ ID NO: 60104 - DNA, 20 bp, Artificial Sequence
  sgRNA
  Tenm3_5
gcaaagtcaacgtattcggc

SEQ ID NO: 60105 - DNA, 20 bp, Artificial Sequence
  sgRNA
  Tenm3_6
gctggtaattggattccacg

SEQ ID NO: 60106 - DNA, 20 bp, Artificial Sequence
  sgRNA
  Tenm3_7
ggaactataggacttctgcg

SEQ ID NO: 60107 - DNA, 20 bp, Artificial Sequence
  sgRNA
  Tenm3_8
gcatccgattcggatccctt

SEQ ID NO: 60108 - DNA, 20 bp, Artificial Sequence
  sgRNA
  Tenm3_9
gcgctatacaaactcgtccg

SEQ ID NO: 60109 - DNA, 20 bp, Artificial Sequence
  sgRNA
  Tenm3_10
caacaccctccgaatccgaa

SEQ ID NO: 60110 - DNA, 20 bp, Artificial Sequence
  sgRNA
  Tenm3_11
acagtgatctatcggtacga

SEQ ID NO: 60111 - DNA, 20 bp, Artificial Sequence
  sgRNA
  Tenm3_12
gccgatgagcgacttgaccg

SEQ ID NO: 60112 - DNA, 20 bp, Artificial Sequence
  sgRNA
  Tenm3_13
cgatctccagaagatcccgg

SEQ ID NO: 60113 - DNA, 20 bp, Artificial Sequence
  sgRNA
  Tenm3_14
cggatcccttcggattcgga

SEQ ID NO: 60114 - DNA, 20 bp, Artificial Sequence
  sgRNA
  Tenm3_15
gccacggtcaagtcgctcat

SEQ ID NO: 60115 - DNA, 20 bp, Artificial Sequence
  sgRNA
  Tenm3_16
gccggtactgaacatcgccc

SEQ ID NO: 60116 - DNA, 20 bp, Artificial Sequence
  sgRNA
  Tenm3_17
cattgctgttgcacaagccg

SEQ ID NO: 60117 - DNA, 20 bp, Artificial Sequence
  sgRNA
  Tenm3_18
gggcgatgttcagtaccggc

SEQ ID NO: 60118 - DNA, 20 bp, Artificial Sequence
  sgRNA
  Tenm3_19
ggcacactgcggctgacgag

SEQ ID NO: 60119 - DNA, 20 bp, Artificial Sequence
  sgRNA
  Tenm3_20
gtagtagccaatggaccgga

SEQ ID NO: 60120 - DNA, 20 bp, Artificial Sequence
  sgRNA
  Tenm4_1
tcacctacgacgagaccgca

SEQ ID NO: 60121 - DNA, 20 bp, Artificial Sequence
  sgRNA
  Tenm4_2
aggagttgatggaggccgcg

SEQ ID NO: 60122 - DNA, 20 bp, Artificial Sequence
  sgRNA
  Tenm4_3
tcttcgagtacaattcagcc

SEQ ID NO: 60123 - DNA, 20 bp, Artificial Sequence
  sgRNA
  Tenm4_4
ggacctggtgaagaactccg

SEQ ID NO: 60124 - DNA, 20 bp, Artificial Sequence
  sgRNA
  Tenm4_5
ccatccaaccatcctcacag

SEQ ID NO: 60125 - DNA, 20 bp, Artificial Sequence
  sgRNA
  Tenm4_6
ctggtcatataggatccgaa

SEQ ID NO: 60126 - DNA, 20 bp, Artificial Sequence
  sgRNA
  Tenm4_7
catacttgtaaatcacccgg

SEQ ID NO: 60127 - DNA, 20 bp, Artificial Sequence
  sgRNA
  Tenm4_8
gttccactgaagacagcaag

SEQ ID NO: 60128 - DNA, 20 bp, Artificial Sequence
  sgRNA
  Tenm4_9
gcttcccagaagattccgcc

SEQ ID NO: 60129 - DNA, 20 bp, Artificial Sequence
  sgRNA
  Tenm4_10
gggagaacccctttgacgga

SEQ ID NO: 60130 - DNA, 20 bp, Artificial Sequence
  sgRNA
  Tenm4_11
ggtcgggagaaggtgctgcg

SEQ ID NO: 60131 - DNA, 20 bp, Artificial Sequence
  sgRNA
  Tenm4_12
gtgtcaggtaccgatacgat

SEQ ID NO: 60132 - DNA, 20 bp, Artificial Sequence
  sgRNA
  Tenm4_13
gattaagcagatcctataca

SEQ ID NO: 60133 - DNA, 20 bp, Artificial Sequence
  sgRNA
  Tenm4_14
tgaccatgcccaacgtagcc

SEQ ID NO: 60134 - DNA, 20 bp, Artificial Sequence
  sgRNA
  Tenm4_15
gcagatgtatgagatcacgg

SEQ ID NO: 60135 - DNA, 20 bp, Artificial Sequence
  sgRNA
  Tenm4_16
ggattcatactcataaccca

SEQ ID NO: 60136 - DNA, 20 bp, Artificial Sequence
  sgRNA
  Tenm4_17
tacccccaaccagcaccacg

SEQ ID NO: 60137 - DNA, 20 bp, Artificial Sequence
  sgRNA
  Tenm4_18
gtaagccccatcatggcggg

SEQ ID NO: 60138 - DNA, 20 bp, Artificial Sequence
  sgRNA
  Tenm4_19
aaccatcgtcatgagacacg

SEQ ID NO: 60139 - DNA, 20 bp, Artificial Sequence
  sgRNA
  Tenm4_20
atgacaaagaagcgatccca

SEQ ID NO: 60140 - DNA, 20 bp, Artificial Sequence
  sgRNA
  Tex101_1
gctcttactggccaaaacga

SEQ ID NO: 60141 - DNA, 20 bp, Artificial Sequence
  sgRNA
  Tex101_2
ttcttctaatcgcctcacgt

SEQ ID NO: 60142 - DNA, 20 bp, Artificial Sequence
  sgRNA
  Tex101_3
tgagttgtgccattggcaca

SEQ ID NO: 60143 - DNA, 20 bp, Artificial Sequence
  sgRNA
  Tex101_4
ccgccactgcccgacatgtg

SEQ ID NO: 60144 - DNA, 20 bp, Artificial Sequence
  sgRNA
  Tex101_5
gcactcgccagactgacgct

SEQ ID NO: 60145 - DNA, 20 bp, Artificial Sequence
  sgRNA
  Tex101_6
ggtccaaaatacctactgcc

SEQ ID NO: 60146 - DNA, 20 bp, Artificial Sequence
  sgRNA
  Tex101_7
gcagcctttaacttgcacgg

SEQ ID NO: 60147 - DNA, 20 bp, Artificial Sequence
  sgRNA
  Tex101_8
tggatcgtcttccagactca

SEQ ID NO: 60148 - DNA, 20 bp, Artificial Sequence
  sgRNA
  Tex101_9
ggtgcagcctttaacttgca

SEQ ID NO: 60149 - DNA, 20 bp, Artificial Sequence
  sgRNA
  Tex101_10
aaaggctgcaccactacgat

SEQ ID NO: 60150 - DNA, 20 bp, Artificial Sequence
  sgRNA
  Tex101_11
tcagatgcccacttcactgt

SEQ ID NO: 60151 - DNA, 20 bp, Artificial Sequence
  sgRNA
  Tex101_12
ggaagacttgaattctctgg

SEQ ID NO: 60152 - DNA, 20 bp, Artificial Sequence
  sgRNA
  Tex101_13
gtcattccttcagccccgga

SEQ ID NO: 60153 - DNA, 20 bp, Artificial Sequence
  sgRNA
  Tex101_14
gcgggttcctgacatgttgg

SEQ ID NO: 60154 - DNA, 20 bp, Artificial Sequence
  sgRNA
  Tex101_15
gacgccaccgtgcaagttaa

SEQ ID NO: 60155 - DNA, 20 bp, Artificial Sequence
  sgRNA
  Tex101_16
gagatggcaaccaggccagg

SEQ ID NO: 60156 - DNA, 20 bp, Artificial Sequence
  sgRNA
  Tex101_17
aggagaactttgccaagaaa

SEQ ID NO: 60157 - DNA, 20 bp, Artificial Sequence
  sgRNA
  Tex101_18
gtatactgcacctcctggcc

SEQ ID NO: 60158 - DNA, 20 bp, Artificial Sequence
  sgRNA
  Tex101_19
ggcactggaacaggagccca

SEQ ID NO: 60159 - DNA, 20 bp, Artificial Sequence
  sgRNA
  Tex101_20
tgtttctcaaggaggagagg

SEQ ID NO: 60160 - DNA, 20 bp, Artificial Sequence
  sgRNA
  Tfpi_1
tgtgaacgattcgtgtacgg

SEQ ID NO: 60161 - DNA, 20 bp, Artificial Sequence
  sgRNA
  Tfpi_2
tgtgaagaatttatatacgg

SEQ ID NO: 60162 - DNA, 20 bp, Artificial Sequence
  sgRNA
  Tfpi_3
accttgtagattctgagctg

SEQ ID NO: 60163 - DNA, 20 bp, Artificial Sequence
  sgRNA
  Tfpi_4
gatacctcttcatgtaacct

SEQ ID NO: 60164 - DNA, 20 bp, Artificial Sequence
  sgRNA
  Tfpi_5
tgtaacctcggcagagtcca

SEQ ID NO: 60165 - DNA, 20 bp, Artificial Sequence
  sgRNA
  Tfpi_6
actcttccagggtatcaaat

SEQ ID NO: 60166 - DNA, 20 bp, Artificial Sequence
  sgRNA
  Tfpi_7
tcatatacaactttcacgaa

SEQ ID NO: 60167 - DNA, 20 bp, Artificial Sequence
  sgRNA
  Tfpi_8
ttatatacgggggatgtgaa

SEQ ID NO: 60168 - DNA, 20 bp, Artificial Sequence
  sgRNA
  Tfpi_9
gtacctcattcactggggaa

SEQ ID NO: 60169 - DNA, 20 bp, Artificial Sequence
  sgRNA
  Tfpi_10
catctgtacctcattcactg

SEQ ID NO: 60170 - DNA, 20 bp, Artificial Sequence
  sgRNA
  Tfpi_11
ataaaggtgatacagtacca

SEQ ID NO: 60171 - DNA, 20 bp, Artificial Sequence
  sgRNA
  Tfpi_12
aaatcggtggcatttcccag

SEQ ID NO: 60172 - DNA, 20 bp, Artificial Sequence
  sgRNA
  Tfpi_13
tgatctcagacatctccttc

SEQ ID NO: 60173 - DNA, 20 bp, Artificial Sequence
  sgRNA
  Tfpi_14
tctactacaattcagccact

SEQ ID NO: 60174 - DNA, 20 bp, Artificial Sequence
  sgRNA
  Tfpi_15
ttacataatccactgtctgc

SEQ ID NO: 60175 - DNA, 20 bp, Artificial Sequence
  sgRNA
  Tfpi_16
cagtactgtaaataacatcg

SEQ ID NO: 60176 - DNA, 20 bp, Artificial Sequence
  sgRNA
  Tfpi_17
ttatgagaagacagctgtga

SEQ ID NO: 60177 - DNA, 20 bp, Artificial Sequence
  sgRNA
  Tfpi_18
gctaagcaacagacacacag

SEQ ID NO: 60178 - DNA, 20 bp, Artificial Sequence
  sgRNA
  Tfpi_19
gttacaaaagaagaaacaaa

SEQ ID NO: 60179 - DNA, 20 bp, Artificial Sequence
  sgRNA
  Tfpi_20
agacggaactcagaaagcct

SEQ ID NO: 60180 - DNA, 20 bp, Artificial Sequence
  sgRNA
  Tgfa_1
aacagcacatcccccctgag

SEQ ID NO: 60181 - DNA, 20 bp, Artificial Sequence
  sgRNA
  Tgfa_2
gggaatacttacacacatgc

SEQ ID NO: 60182 - DNA, 20 bp, Artificial Sequence
  sgRNA
  Tgfa_3
atggaagcagtactgagtgt

SEQ ID NO: 60183 - DNA, 20 bp, Artificial Sequence
  sgRNA
  Tgfa_4
ttcctgcaccaaaaaccggc

SEQ ID NO: 60184 - DNA, 20 bp, Artificial Sequence
  sgRNA
  Tgfa_5
tctcttcctgcaccaaaaac

SEQ ID NO: 60185 - DNA, 20 bp, Artificial Sequence
  sgRNA
  Tgfa_6
gagcctggcacacagctaac

SEQ ID NO: 60186 - DNA, 20 bp, Artificial Sequence
  sgRNA
  Tgfa_7
cttctcatgtctgcagacga

SEQ ID NO: 60187 - DNA, 20 bp, Artificial Sequence
  sgRNA
  Tgfa_8
ggtgataatgaggacagcca

SEQ ID NO: 60188 - DNA, 20 bp, Artificial Sequence
  sgRNA
  Tgfa_9
catgtctgcagacgagggca

SEQ ID NO: 60189 - DNA, 20 bp, Artificial Sequence
  sgRNA
  Tgfa_10
tggtctgaagatcccagagg

SEQ ID NO: 60190 - DNA, 20 bp, Artificial Sequence
  sgRNA
  Tgfa_11
agcagtccttcccttcagga

SEQ ID NO: 60191 - DNA, 20 bp, Artificial Sequence
  sgRNA
  Tgfa_12
cagctcgctctgctagcgct

SEQ ID NO: 60192 - DNA, 20 bp, Artificial Sequence
  sgRNA
  Tgfa_13
ccaaaaaccggcaggttcca

SEQ ID NO: 60193 - DNA, 20 bp, Artificial Sequence
  sgRNA
  Tgfa_14
aagcagtccttcccttcagg

SEQ ID NO: 60194 - DNA, 20 bp, Artificial Sequence
  sgRNA
  Tgfa_15
aagcccagcgccctcctgaa

SEQ ID NO: 60195 - DNA, 20 bp, Artificial Sequence
  sgRNA
  Tgfa_16
actgcttccatggaacctgc

SEQ ID NO: 60196 - DNA, 20 bp, Artificial Sequence
  sgRNA
  Tgfa_17
agaggaggaatttggccagg

SEQ ID NO: 60197 - DNA, 20 bp, Artificial Sequence
  sgRNA
  Tgfa_18
cacaatggagaccaccacca

SEQ ID NO: 60198 - DNA, 20 bp, Artificial Sequence
  sgRNA
  Tgfa_19
gatggcttgcttcttctggc

SEQ ID NO: 60199 - DNA, 20 bp, Artificial Sequence
  sgRNA
  Tgfa_20
acagctcgctctgctagcgc

SEQ ID NO: 60200 - DNA, 20 bp, Artificial Sequence
  sgRNA
  Tgfbr1_1
agagcgttcatggttccgag

SEQ ID NO: 60201 - DNA, 20 bp, Artificial Sequence
  sgRNA
  Tgfbr1_2
atgaaagggcgatctagtga

SEQ ID NO: 60202 - DNA, 20 bp, Artificial Sequence
  sgRNA
  Tgfbr1_3
attgtgttacaagaaagcat

SEQ ID NO: 60203 - DNA, 20 bp, Artificial Sequence
  sgRNA
  Tgfbr1_4
gtgtcagattatcatgagca

SEQ ID NO: 60204 - DNA, 20 bp, Artificial Sequence
  sgRNA
  Tgfbr1_5
tgcaccatcttcaaaaacag

SEQ ID NO: 60205 - DNA, 20 bp, Artificial Sequence
  sgRNA
  Tgfbr1_6
gtttggcgaggcaaatggcg

SEQ ID NO: 60206 - DNA, 20 bp, Artificial Sequence
  sgRNA
  Tgfbr1_7
gctcgacgctgttctattgg

SEQ ID NO: 60207 - DNA, 20 bp, Artificial Sequence
  sgRNA
  Tgfbr1_8
attgtcacaactcagccaac

SEQ ID NO: 60208 - DNA, 20 bp, Artificial Sequence
  sgRNA
  Tgfbr1_9
tgtctgctgctataaatccc

SEQ ID NO: 60209 - DNA, 20 bp, Artificial Sequence
  sgRNA
  Tgfbr1_10
gatcgccctttcatttcaga

SEQ ID NO: 60210 - DNA, 20 bp, Artificial Sequence
  sgRNA
  Tgfbr1_11
tcttcaaccgatggatcaga

SEQ ID NO: 60211 - DNA, 20 bp, Artificial Sequence
  sgRNA
  Tgfbr1_12
gctcctcatcgtgttggtgg

SEQ ID NO: 60212 - DNA, 20 bp, Artificial Sequence
  sgRNA
  Tgfbr1_13
aagtttggcgaggcaaatgg

SEQ ID NO: 60213 - DNA, 20 bp, Artificial Sequence
  sgRNA
  Tgfbr1_14
tcttgtaccttctgatccat

SEQ ID NO: 60214 - DNA, 20 bp, Artificial Sequence
  sgRNA
  Tgfbr1_15
ggccaaatattccaaacaga

SEQ ID NO: 60215 - DNA, 20 bp, Artificial Sequence
  sgRNA
  Tgfbr1_16
agtttggcgaggcaaatggc

SEQ ID NO: 60216 - DNA, 20 bp, Artificial Sequence
  sgRNA
  Tgfbr1_17
atagatgtcagcgcgtttga

SEQ ID NO: 60217 - DNA, 20 bp, Artificial Sequence
  sgRNA
  Tgfbr1_18
ggtatgccaatggagcagca

SEQ ID NO: 60218 - DNA, 20 bp, Artificial Sequence
  sgRNA
  Tgfbr1_19
gatcctcttcatttggcaca

SEQ ID NO: 60219 - DNA, 20 bp, Artificial Sequence
  sgRNA
  Tgfbr1_20
tcccaagtctgcaatacaac

SEQ ID NO: 60220 - DNA, 20 bp, Artificial Sequence
  sgRNA
  Tgfbr2_1
cctacgaggagtactcctcg

SEQ ID NO: 60221 - DNA, 20 bp, Artificial Sequence
  sgRNA
  Tgfbr2_2
acctgcaggagtacctcacg

SEQ ID NO: 60222 - DNA, 20 bp, Artificial Sequence
  sgRNA
  Tgfbr2_3
gaagccgcatgaagtctgcg

SEQ ID NO: 60223 - DNA, 20 bp, Artificial Sequence
  sgRNA
  Tgfbr2_4
ccttgtagacctcggcgaag

SEQ ID NO: 60224 - DNA, 20 bp, Artificial Sequence
  sgRNA
  Tgfbr2_5
gctatggcaatccccagcgg

SEQ ID NO: 60225 - DNA, 20 bp, Artificial Sequence
  sgRNA
  Tgfbr2_6
cctgcaggttgcccttcgcg

SEQ ID NO: 60226 - DNA, 20 bp, Artificial Sequence
  sgRNA
  Tgfbr2_7
catcttccagagtgaagccg

SEQ ID NO: 60227 - DNA, 20 bp, Artificial Sequence
  sgRNA
  Tgfbr2_8
atcacggcgttccacgcgaa

SEQ ID NO: 60228 - DNA, 20 bp, Artificial Sequence
  sgRNA
  Tgfbr2_9
ggtcatccacagacagagta

SEQ ID NO: 60229 - DNA, 20 bp, Artificial Sequence
  sgRNA
  Tgfbr2_10
cgcaccttggaaccaaatgg

SEQ ID NO: 60230 - DNA, 20 bp, Artificial Sequence
  sgRNA
  Tgfbr2_11
ctttcatgctctccacacag

SEQ ID NO: 60231 - DNA, 20 bp, Artificial Sequence
  sgRNA
  Tgfbr2_12
ctgaaatccatcagtttccg

SEQ ID NO: 60232 - DNA, 20 bp, Artificial Sequence
  sgRNA
  Tgfbr2_13
tgtcaagatcttcccctacg

SEQ ID NO: 60233 - DNA, 20 bp, Artificial Sequence
  sgRNA
  Tgfbr2_14
cctggattctagaacttccg

SEQ ID NO: 60234 - DNA, 20 bp, Artificial Sequence
  sgRNA
  Tgfbr2_15
tctactgctaccgtgtccac

SEQ ID NO: 60235 - DNA, 20 bp, Artificial Sequence
  sgRNA
  Tgfbr2_16
acgaggagtactcctcgtag

SEQ ID NO: 60236 - DNA, 20 bp, Artificial Sequence
  sgRNA
  Tgfbr2_17
gaacatcctgcagttcctga

SEQ ID NO: 60237 - DNA, 20 bp, Artificial Sequence
  sgRNA
  Tgfbr2_18
tcgcaaaacttgcacagctg

SEQ ID NO: 60238 - DNA, 20 bp, Artificial Sequence
  sgRNA
  Tgfbr2_19
tggatgacctggccaacagc

SEQ ID NO: 60239 - DNA, 20 bp, Artificial Sequence
  sgRNA
  Tgfbr2_20
tctttcatgctctccacaca

SEQ ID NO: 60240 - DNA, 20 bp, Artificial Sequence
  sgRNA
  Tgfbr3_1
gctgtggtactagacatagg

SEQ ID NO: 60241 - DNA, 20 bp, Artificial Sequence
  sgRNA
  Tgfbr3_2
catcttcggcttgagaacaa

SEQ ID NO: 60242 - DNA, 20 bp, Artificial Sequence
  sgRNA
  Tgfbr3_3
attgtcacatttgactgaca

SEQ ID NO: 60243 - DNA, 20 bp, Artificial Sequence
  sgRNA
  Tgfbr3_4
aacctccgcagtacagacca

SEQ ID NO: 60244 - DNA, 20 bp, Artificial Sequence
  sgRNA
  Tgfbr3_5
actggatgagaggcactgat

SEQ ID NO: 60245 - DNA, 20 bp, Artificial Sequence
  sgRNA
  Tgfbr3_6
gatcggagcactcctgacgg

SEQ ID NO: 60246 - DNA, 20 bp, Artificial Sequence
  sgRNA
  Tgfbr3_7
gtactggagtctccgctgaa

SEQ ID NO: 60247 - DNA, 20 bp, Artificial Sequence
  sgRNA
  Tgfbr3_8
tgatcggtgacagttcacac

SEQ ID NO: 60248 - DNA, 20 bp, Artificial Sequence
  sgRNA
  Tgfbr3_9
ggtgcaggctccatcccctg

SEQ ID NO: 60249 - DNA, 20 bp, Artificial Sequence
  sgRNA
  Tgfbr3_10
gccagccactgctatcccca

SEQ ID NO: 60250 - DNA, 20 bp, Artificial Sequence
  sgRNA
  Tgfbr3_11
gcgtttgcagcatttgtgat

SEQ ID NO: 60251 - DNA, 20 bp, Artificial Sequence
  sgRNA
  Tgfbr3_12
atatgcacttccttctcgtg

SEQ ID NO: 60252 - DNA, 20 bp, Artificial Sequence
  sgRNA
  Tgfbr3_13
cgctcatcaggacaaacaca

SEQ ID NO: 60253 - DNA, 20 bp, Artificial Sequence
  sgRNA
  Tgfbr3_14
tgtcaattattatatccacc

SEQ ID NO: 60254 - DNA, 20 bp, Artificial Sequence
  sgRNA
  Tgfbr3_15
tgggttgaaggtactccgca

SEQ ID NO: 60255 - DNA, 20 bp, Artificial Sequence
  sgRNA
  Tgfbr3_16
tccctatgttacacgtggga

SEQ ID NO: 60256 - DNA, 20 bp, Artificial Sequence
  sgRNA
  Tgfbr3_17
gtgggagtagatataccaca

SEQ ID NO: 60257 - DNA, 20 bp, Artificial Sequence
  sgRNA
  Tgfbr3_18
ggacaaacacagggaccatg

SEQ ID NO: 60258 - DNA, 20 bp, Artificial Sequence
  sgRNA
  Tgfbr3_19
ggccaggacacaaccttcgg

SEQ ID NO: 60259 - DNA, 20 bp, Artificial Sequence
  sgRNA
  Tgfbr3_20
tctctcgctcaattaccttg

SEQ ID NO: 60260 - DNA, 20 bp, Artificial Sequence
  sgRNA
  Tgoln1_1
caaactgtgatcggtcgcgg

SEQ ID NO: 60261 - DNA, 20 bp, Artificial Sequence
  sgRNA
  Tgoln1_2
aagactacaaggccgaccga

SEQ ID NO: 60262 - DNA, 20 bp, Artificial Sequence
  sgRNA
  Tgoln1_3
ccgagttgaacgaaactgcg

SEQ ID NO: 60263 - DNA, 20 bp, Artificial Sequence
  sgRNA
  Tgoln1_4
ggagtggaggactgtttgga

SEQ ID NO: 60264 - DNA, 20 bp, Artificial Sequence
  sgRNA
  Tgoln1_5
gcgtctctcttataaacgga

SEQ ID NO: 60265 - DNA, 20 bp, Artificial Sequence
  sgRNA
  Tgoln1_6
tgacttctgcccctgaccgt

SEQ ID NO: 60266 - DNA, 20 bp, Artificial Sequence
  sgRNA
  Tgoln1_7
ggaatcacccaaactgtgat

SEQ ID NO: 60267 - DNA, 20 bp, Artificial Sequence
  sgRNA
  Tgoln1_8
gtaaggcggaatctgggccg

SEQ ID NO: 60268 - DNA, 20 bp, Artificial Sequence
  sgRNA
  Tgoln1_9
ggcagcagtttccagtaagg

SEQ ID NO: 60269 - DNA, 20 bp, Artificial Sequence
  sgRNA
  Tgoln1_10
ggtaattctggcaagcccac

SEQ ID NO: 60270 - DNA, 20 bp, Artificial Sequence
  sgRNA
  Tgoln1_11
ttacctggttagaagaaggc

SEQ ID NO: 60271 - DNA, 20 bp, Artificial Sequence
  sgRNA
  Tgoln1_12
ccgcgcagtttcgttcaact

SEQ ID NO: 60272 - DNA, 20 bp, Artificial Sequence
  sgRNA
  Tgoln1_13
gtcggcgtctctcttataaa

SEQ ID NO: 60273 - DNA, 20 bp, Artificial Sequence
  sgRNA
  Tgoln1_14
cctccagtgagaaccaagag

SEQ ID NO: 60274 - DNA, 20 bp, Artificial Sequence
  sgRNA
  Tgoln1_15
gccgcgaccgatcacagttt

SEQ ID NO: 60275 - DNA, 20 bp, Artificial Sequence
  sgRNA
  Tgoln1_16
gtcaccctcttcaatctcct

SEQ ID NO: 60276 - DNA, 20 bp, Artificial Sequence
  sgRNA
  Tgoln1_17
gctcctgctgagtgtcgcgg

SEQ ID NO: 60277 - DNA, 20 bp, Artificial Sequence
  sgRNA
  Tgoln1_18
acccaaactgtgatcggtcg

SEQ ID NO: 60278 - DNA, 20 bp, Artificial Sequence
  sgRNA
  Tgoln1_19
ttcctccagtgagaaccaag

SEQ ID NO: 60279 - DNA, 20 bp, Artificial Sequence
  sgRNA
  Tgoln1_20
gaaaccaaggagattgaaga

SEQ ID NO: 60280 - DNA, 20 bp, Artificial Sequence
  sgRNA
  Thbd_1
tacctacaacaccccgttcg

SEQ ID NO: 60281 - DNA, 20 bp, Artificial Sequence
  sgRNA
  Thbd_2
gtgtgagacaggctaccagt

SEQ ID NO: 60282 - DNA, 20 bp, Artificial Sequence
  sgRNA
  Thbd_3
ctgtgaagtaaaactcacag

SEQ ID NO: 60283 - DNA, 20 bp, Artificial Sequence
  sgRNA
  Thbd_4
tcgcagttagatccgaaaca

SEQ ID NO: 60284 - DNA, 20 bp, Artificial Sequence
  sgRNA
  Thbd_5
accgcggcggaactgcctac

SEQ ID NO: 60285 - DNA, 20 bp, Artificial Sequence
  sgRNA
  Thbd_6
gggagctgtaaaccgatcca

SEQ ID NO: 60286 - DNA, 20 bp, Artificial Sequence
  sgRNA
  Thbd_7
gaaggcttcatcctggacga

SEQ ID NO: 60287 - DNA, 20 bp, Artificial Sequence
  sgRNA
  Thbd_8
ggttatcgccagtaacccac

SEQ ID NO: 60288 - DNA, 20 bp, Artificial Sequence
  sgRNA
  Thbd_9
acagcaactgaagctgcacc

SEQ ID NO: 60289 - DNA, 20 bp, Artificial Sequence
  sgRNA
  Thbd_10
gactttcaaacgctgccggt

SEQ ID NO: 60290 - DNA, 20 bp, Artificial Sequence
  sgRNA
  Thbd_11
ataaccacaccagttacagc

SEQ ID NO: 60291 - DNA, 20 bp, Artificial Sequence
  sgRNA
  Thbd_12
tggcatcgaggaaggtcgcg

SEQ ID NO: 60292 - DNA, 20 bp, Artificial Sequence
  sgRNA
  Thbd_13
tcgagaccgtgacgcacaga

SEQ ID NO: 60293 - DNA, 20 bp, Artificial Sequence
  sgRNA
  Thbd_14
cctacgccaggctctccgac

SEQ ID NO: 60294 - DNA, 20 bp, Artificial Sequence
  sgRNA
  Thbd_15
aggagcctggaattgcagcg

SEQ ID NO: 60295 - DNA, 20 bp, Artificial Sequence
  sgRNA
  Thbd_16
tgtccctctgaagttccggg

SEQ ID NO: 60296 - DNA, 20 bp, Artificial Sequence
  sgRNA
  Thbd_17
tgtcacctgcgcaagaagca

SEQ ID NO: 60297 - DNA, 20 bp, Artificial Sequence
  sgRNA
  Thbd_18
gcagatgcatcggtagtcgg

SEQ ID NO: 60298 - DNA, 20 bp, Artificial Sequence
  sgRNA
  Thbd_19
ggtgtccgtctgcagccaac

SEQ ID NO: 60299 - DNA, 20 bp, Artificial Sequence
  sgRNA
  Thbd_20
acgtggatgactgtaagcag

SEQ ID NO: 60300 - DNA, 20 bp, Artificial Sequence
  sgRNA
  Thsd1_1
gatgccggtgacggacctag

SEQ ID NO: 60301 - DNA, 20 bp, Artificial Sequence
  sgRNA
  Thsd1_2
tcagggggctttgagatacg

SEQ ID NO: 60302 - DNA, 20 bp, Artificial Sequence
  sgRNA
  Thsd1_3
acaacgtggtgaccgtcaca

SEQ ID NO: 60303 - DNA, 20 bp, Artificial Sequence
  sgRNA
  Thsd1_4
agaagcccccaaacgcccgg

SEQ ID NO: 60304 - DNA, 20 bp, Artificial Sequence
  sgRNA
  Thsd1_5
tcacagataaggtcgaccgg

SEQ ID NO: 60305 - DNA, 20 bp, Artificial Sequence
  sgRNA
  Thsd1_6
gcatccgagaagcttccgcg

SEQ ID NO: 60306 - DNA, 20 bp, Artificial Sequence
  sgRNA
  Thsd1_7
ggaggagaggactttccagg

SEQ ID NO: 60307 - DNA, 20 bp, Artificial Sequence
  sgRNA
  Thsd1_8
atccggcctgacgatcccct

SEQ ID NO: 60308 - DNA, 20 bp, Artificial Sequence
  sgRNA
  Thsd1_9
cttagtggtaagagtccgat

SEQ ID NO: 60309 - DNA, 20 bp, Artificial Sequence
  sgRNA
  Thsd1_10
ggaggtattcggcttctccg

SEQ ID NO: 60310 - DNA, 20 bp, Artificial Sequence
  sgRNA
  Thsd1_11
tgtgggaggccaacaccaat

SEQ ID NO: 60311 - DNA, 20 bp, Artificial Sequence
  sgRNA
  Thsd1_12
tttcactgaccgtcttccgg

SEQ ID NO: 60312 - DNA, 20 bp, Artificial Sequence
  sgRNA
  Thsd1_13
tgtggcactgagcgacagaa

SEQ ID NO: 60313 - DNA, 20 bp, Artificial Sequence
  sgRNA
  Thsd1_14
tgtggtttcgtcctcttcgt

SEQ ID NO: 60314 - DNA, 20 bp, Artificial Sequence
  sgRNA
  Thsd1_15
ggcattccaggtctaaggga

SEQ ID NO: 60315 - DNA, 20 bp, Artificial Sequence
  sgRNA
  Thsd1_16
atacttcggctccaacgaag

SEQ ID NO: 60316 - DNA, 20 bp, Artificial Sequence
  sgRNA
  Thsd1_17
gtgtcccgttgacgtcactg

SEQ ID NO: 60317 - DNA, 20 bp, Artificial Sequence
  sgRNA
  Thsd1_18
agacctggaatgccccgaag

SEQ ID NO: 60318 - DNA, 20 bp, Artificial Sequence
  sgRNA
  Thsd1_19
ccttggacgaagacacaagg

SEQ ID NO: 60319 - DNA, 20 bp, Artificial Sequence
  sgRNA
  Thsd1_20
aggcggtagctaaacaaggg

SEQ ID NO: 60320 - DNA, 20 bp, Artificial Sequence
  sgRNA
  Thsd7a_1
ctgtaggggatgtgacatcg

SEQ ID NO: 60321 - DNA, 20 bp, Artificial Sequence
  sgRNA
  Thsd7a_2
catctgtgtgcgagtcaacg

SEQ ID NO: 60322 - DNA, 20 bp, Artificial Sequence
  sgRNA
  Thsd7a_3
tgtgcgttatatttgtcaca

SEQ ID NO: 60323 - DNA, 20 bp, Artificial Sequence
  sgRNA
  Thsd7a_4
cgcgaaaagccttataacgg

SEQ ID NO: 60324 - DNA, 20 bp, Artificial Sequence
  sgRNA
  Thsd7a_5
ttgacaccagactgtccgag

SEQ ID NO: 60325 - DNA, 20 bp, Artificial Sequence
  sgRNA
  Thsd7a_6
aggataccgttaccaagcga

SEQ ID NO: 60326 - DNA, 20 bp, Artificial Sequence
  sgRNA
  Thsd7a_7
gtactcgcagatgatgtcct

SEQ ID NO: 60327 - DNA, 20 bp, Artificial Sequence
  sgRNA
  Thsd7a_8
gtacccttcttcacagcggc

SEQ ID NO: 60328 - DNA, 20 bp, Artificial Sequence
  sgRNA
  Thsd7a_9
gcaatgcacacttattcccg

SEQ ID NO: 60329 - DNA, 20 bp, Artificial Sequence
  sgRNA
  Thsd7a_10
actatcacacagtttccgat

SEQ ID NO: 60330 - DNA, 20 bp, Artificial Sequence
  sgRNA
  Thsd7a_11
gctttggtggaatacaagtc

SEQ ID NO: 60331 - DNA, 20 bp, Artificial Sequence
  sgRNA
  Thsd7a_12
tcgtggcaagaacaaggaga

SEQ ID NO: 60332 - DNA, 20 bp, Artificial Sequence
  sgRNA
  Thsd7a_13
ggagatgactgtggaccggg

SEQ ID NO: 60333 - DNA, 20 bp, Artificial Sequence
  sgRNA
  Thsd7a_14
atacgaccacaacatggaat

SEQ ID NO: 60334 - DNA, 20 bp, Artificial Sequence
  sgRNA
  Thsd7a_15
aataagtgtgcattgctcaa

SEQ ID NO: 60335 - DNA, 20 bp, Artificial Sequence
  sgRNA
  Thsd7a_16
cgtcctgctgggttaatgga

SEQ ID NO: 60336 - DNA, 20 bp, Artificial Sequence
  sgRNA
  Thsd7a_17
ggcacacctgaaactcggtg

SEQ ID NO: 60337 - DNA, 20 bp, Artificial Sequence
  sgRNA
  Thsd7a_18
attcaattggacaaggaacg

SEQ ID NO: 60338 - DNA, 20 bp, Artificial Sequence
  sgRNA
  Thsd7a_19
gctctttctccacagcatca

SEQ ID NO: 60339 - DNA, 20 bp, Artificial Sequence
  sgRNA
  Thsd7a_20
agcacgccatcgcttggtaa

SEQ ID NO: 60340 - DNA, 20 bp, Artificial Sequence
  sgRNA
  Thsd7b_1
ataaacgtatcacagggaca

SEQ ID NO: 60341 - DNA, 20 bp, Artificial Sequence
  sgRNA
  Thsd7b_2
actgcagcatagaactcgtg

SEQ ID NO: 60342 - DNA, 20 bp, Artificial Sequence
  sgRNA
  Thsd7b_3
agcaatacagatcccttccg

SEQ ID NO: 60343 - DNA, 20 bp, Artificial Sequence
  sgRNA
  Thsd7b_4
ggtgggcattcagacacgaa

SEQ ID NO: 60344 - DNA, 20 bp, Artificial Sequence
  sgRNA
  Thsd7b_5
ctatgcagtccatcgagcaa

SEQ ID NO: 60345 - DNA, 20 bp, Artificial Sequence
  sgRNA
  Thsd7b_6
ccaaggacccaactatagca

SEQ ID NO: 60346 - DNA, 20 bp, Artificial Sequence
  sgRNA
  Thsd7b_7
ggatctgtattgctgatcat

SEQ ID NO: 60347 - DNA, 20 bp, Artificial Sequence
  sgRNA
  Thsd7b_8
gctctcatcacagttcgaca

SEQ ID NO: 60348 - DNA, 20 bp, Artificial Sequence
  sgRNA
  Thsd7b_9
gtctttggaacaataatgag

SEQ ID NO: 60349 - DNA, 20 bp, Artificial Sequence
  sgRNA
  Thsd7b_10
gtaatctggaaaaaccccag

SEQ ID NO: 60350 - DNA, 20 bp, Artificial Sequence
  sgRNA
  Thsd7b_11
gtgagtgtgtcatgtccgag

SEQ ID NO: 60351 - DNA, 20 bp, Artificial Sequence
  sgRNA
  Thsd7b_12
gcacgactttgggctccgcc

SEQ ID NO: 60352 - DNA, 20 bp, Artificial Sequence
  sgRNA
  Thsd7b_13
tcacctgcacaccttcccca

SEQ ID NO: 60353 - DNA, 20 bp, Artificial Sequence
  sgRNA
  Thsd7b_14
agaactgccatgatcctcag

SEQ ID NO: 60354 - DNA, 20 bp, Artificial Sequence
  sgRNA
  Thsd7b_15
gcattgtcgaccttctcctt

SEQ ID NO: 60355 - DNA, 20 bp, Artificial Sequence
  sgRNA
  Thsd7b_16
aatggtgcattcctgcacaa

SEQ ID NO: 60356 - DNA, 20 bp, Artificial Sequence
  sgRNA
  Thsd7b_17
tctgcagtgtccaaatctca

SEQ ID NO: 60357 - DNA, 20 bp, Artificial Sequence
  sgRNA
  Thsd7b_18
tcacaagccattcgttcagg

SEQ ID NO: 60358 - DNA, 20 bp, Artificial Sequence
  sgRNA
  Thsd7b_19
atagcatgctccaatataaa

SEQ ID NO: 60359 - DNA, 20 bp, Artificial Sequence
  sgRNA
  Thsd7b_20
atgtccttgacctagattgg

SEQ ID NO: 60360 - DNA, 20 bp, Artificial Sequence
  sgRNA
  Thy1_1
ccttggtgttattctcatgg

SEQ ID NO: 60361 - DNA, 20 bp, Artificial Sequence
  sgRNA
  Thy1_2
taaggaccttgatatagggc

SEQ ID NO: 60362 - DNA, 20 bp, Artificial Sequence
  sgRNA
  Thy1_3
cagtcttgcaggtgtcccga

SEQ ID NO: 60363 - DNA, 20 bp, Artificial Sequence
  sgRNA
  Thy1_4
cgtgtgctcgggtatcccaa

SEQ ID NO: 60364 - DNA, 20 bp, Artificial Sequence
  sgRNA
  Thy1_5
ccgccatgagaataacacca

SEQ ID NO: 60365 - DNA, 20 bp, Artificial Sequence
  sgRNA
  Thy1_6
gacaagctggtcaagtgtgg

SEQ ID NO: 60366 - DNA, 20 bp, Artificial Sequence
  sgRNA
  Thy1_7
ggtgaaccaaaaccttcgcc

SEQ ID NO: 60367 - DNA, 20 bp, Artificial Sequence
  sgRNA
  Thy1_8
gggtcaggctgaactcatgc

SEQ ID NO: 60368 - DNA, 20 bp, Artificial Sequence
  sgRNA
  Thy1_9
acgtgctctcaggcaccctt

SEQ ID NO: 60369 - DNA, 20 bp, Artificial Sequence
  sgRNA
  Thy1_10
catggcggcagtccaggcga

SEQ ID NO: 60370 - DNA, 20 bp, Artificial Sequence
  sgRNA
  Thy1_11
cctagccaacttcaccacca

SEQ ID NO: 60371 - DNA, 20 bp, Artificial Sequence
  sgRNA
  Thy1_12
tcagcctgacccgagagaag

SEQ ID NO: 60372 - DNA, 20 bp, Artificial Sequence
  sgRNA
  Thy1_13
gatatagggctggttggaga

SEQ ID NO: 60373 - DNA, 20 bp, Artificial Sequence
  sgRNA
  Thy1_14
tgtctccccaaattcagaga

SEQ ID NO: 60374 - DNA, 20 bp, Artificial Sequence
  sgRNA
  Thy1_15
gcagtgccttctctgaattt

SEQ ID NO: 60375 - DNA, 20 bp, Artificial Sequence
  sgRNA
  Thy1_16
tttggggagacacagacccg

SEQ ID NO: 60376 - DNA, 20 bp, Artificial Sequence
  sgRNA
  Thy1_17
aggatgtgttctgaaccagc

SEQ ID NO: 60377 - DNA, 20 bp, Artificial Sequence
  sgRNA
  Thy1_18
cttggtggtgaagttggcta

SEQ ID NO: 60378 - DNA, 20 bp, Artificial Sequence
  sgRNA
  Thy1_19
gtagtcgccctcatccttgg

SEQ ID NO: 60379 - DNA, 20 bp, Artificial Sequence
  sgRNA
  Thy1_20
gcacgtgcttcctcttctct

SEQ ID NO: 60380 - DNA, 20 bp, Artificial Sequence
  sgRNA
  Tie1_1
ggccaccagaagtcgatacg

SEQ ID NO: 60381 - DNA, 20 bp, Artificial Sequence
  sgRNA
  Tie1_2
aagacgcctaccaaatccga

SEQ ID NO: 60382 - DNA, 20 bp, Artificial Sequence
  sgRNA
  Tie1_3
gatatcgtgtgctagcattg

SEQ ID NO: 60383 - DNA, 20 bp, Artificial Sequence
  sgRNA
  Tie1_4
caataccctagactggcaag

SEQ ID NO: 60384 - DNA, 20 bp, Artificial Sequence
  sgRNA
  Tie1_5
gtacatcgtggagattcagg

SEQ ID NO: 60385 - DNA, 20 bp, Artificial Sequence
  sgRNA
  Tie1_6
gcttcttcggatacacacca

SEQ ID NO: 60386 - DNA, 20 bp, Artificial Sequence
  sgRNA
  Tie1_7
gatacagtcgcacatccagc

SEQ ID NO: 60387 - DNA, 20 bp, Artificial Sequence
  sgRNA
  Tie1_8
ggcacttgtgaccggttcag

SEQ ID NO: 60388 - DNA, 20 bp, Artificial Sequence
  sgRNA
  Tie1_9
gttcacctgcaaagtctcga

SEQ ID NO: 60389 - DNA, 20 bp, Artificial Sequence
  sgRNA
  Tie1_10
gctgcctcaaggctatcgca

SEQ ID NO: 60390 - DNA, 20 bp, Artificial Sequence
  sgRNA
  Tie1_11
agagtgggcctaccgctggg

SEQ ID NO: 60391 - DNA, 20 bp, Artificial Sequence
  sgRNA
  Tie1_12
tgtggcatcgatgcccgcat

SEQ ID NO: 60392 - DNA, 20 bp, Artificial Sequence
  sgRNA
  Tie1_13
acgtgccagctctctagcca

SEQ ID NO: 60393 - DNA, 20 bp, Artificial Sequence
  sgRNA
  Tie1_14
actaaggtactgcatgccgt

SEQ ID NO: 60394 - DNA, 20 bp, Artificial Sequence
  sgRNA
  Tie1_15
aacagccatagggatccggg

SEQ ID NO: 60395 - DNA, 20 bp, Artificial Sequence
  sgRNA
  Tie1_16
gcagctgcacagttgatccg

SEQ ID NO: 60396 - DNA, 20 bp, Artificial Sequence
  sgRNA
  Tie1_17
tccagcacggggtaactcaa

SEQ ID NO: 60397 - DNA, 20 bp, Artificial Sequence
  sgRNA
  Tie1_18
tcaccggacagtggcaccga

SEQ ID NO: 60398 - DNA, 20 bp, Artificial Sequence
  sgRNA
  Tie1_19
tgtgagctggtctctaccct

SEQ ID NO: 60399 - DNA, 20 bp, Artificial Sequence
  sgRNA
  Tie1_20
tcaacatagggacgatgccc

SEQ ID NO: 60400 - DNA, 20 bp, Artificial Sequence
  sgRNA
  Tigit_1
cctatcatacgtatcctggt

SEQ ID NO: 60401 - DNA, 20 bp, Artificial Sequence
  sgRNA
  Tigit_2
caggcacgatagatacaaag

SEQ ID NO: 60402 - DNA, 20 bp, Artificial Sequence
  sgRNA
  Tigit_3
tctctgacaatgaatgacac

SEQ ID NO: 60403 - DNA, 20 bp, Artificial Sequence
  sgRNA
  Tigit_4
ccatttatagtgttgacctg

SEQ ID NO: 60404 - DNA, 20 bp, Artificial Sequence
  sgRNA
  Tigit_5
agccatggttcctccaagcg

SEQ ID NO: 60405 - DNA, 20 bp, Artificial Sequence
  sgRNA
  Tigit_6
tatcctggtgggatttacaa

SEQ ID NO: 60406 - DNA, 20 bp, Artificial Sequence
  sgRNA
  Tigit_7
gcagccatggttcctccaag

SEQ ID NO: 60407 - DNA, 20 bp, Artificial Sequence
  sgRNA
  Tigit_8
atcctggtgggatttacaag

SEQ ID NO: 60408 - DNA, 20 bp, Artificial Sequence
  sgRNA
  Tigit_9
acctatcatacgtatcctgg

SEQ ID NO: 60409 - DNA, 20 bp, Artificial Sequence
  sgRNA
  Tigit_10
agatgactatgctgacccac

SEQ ID NO: 60410 - DNA, 20 bp, Artificial Sequence
  sgRNA
  Tigit_11
ctgaagtgacccaagtcgac

SEQ ID NO: 60411 - DNA, 20 bp, Artificial Sequence
  sgRNA
  Tigit_12
ggacattaaagtattcctgt

SEQ ID NO: 60412 - DNA, 20 bp, Artificial Sequence
  sgRNA
  Tigit_13
cattctatagaaagtggcct

SEQ ID NO: 60413 - DNA, 20 bp, Artificial Sequence
  sgRNA
  Tigit_14
tgtcattcattgtcagagac

SEQ ID NO: 60414 - DNA, 20 bp, Artificial Sequence
  sgRNA
  Tigit_15
ctccccttgtaaatcccacc

SEQ ID NO: 60415 - DNA, 20 bp, Artificial Sequence
  sgRNA
  Tigit_16
tgtctggacagggcttccag

SEQ ID NO: 60416 - DNA, 20 bp, Artificial Sequence
  sgRNA
  Tigit_17
ggtcacttcagctgtgtcag

SEQ ID NO: 60417 - DNA, 20 bp, Artificial Sequence
  sgRNA
  Tigit_18
tgccccgcttggaggaacca

SEQ ID NO: 60418 - DNA, 20 bp, Artificial Sequence
  sgRNA
  Tigit_19
tcgcttcagtcttcagtgat

SEQ ID NO: 60419 - DNA, 20 bp, Artificial Sequence
  sgRNA
  Tigit_20
ccccaggtcaacactataaa

SEQ ID NO: 60420 - DNA, 20 bp, Artificial Sequence
  sgRNA
  Timd2_1
gatatacggtcacacatcag

SEQ ID NO: 60421 - DNA, 20 bp, Artificial Sequence
  sgRNA
  Timd2_2
ggaatcgttcctatgtgttg

SEQ ID NO: 60422 - DNA, 20 bp, Artificial Sequence
  sgRNA
  Timd2_3
tgttggaagttaaaccaggt

SEQ ID NO: 60423 - DNA, 20 bp, Artificial Sequence
  sgRNA
  Timd2_4
ctgatctggataaaatgtag

SEQ ID NO: 60424 - DNA, 20 bp, Artificial Sequence
  sgRNA
  Timd2_5
tggagcttcccccaaaaaag

SEQ ID NO: 60425 - DNA, 20 bp, Artificial Sequence
  sgRNA
  Timd2_6
tccagatcagactacagctg

SEQ ID NO: 60426 - DNA, 20 bp, Artificial Sequence
  sgRNA
  Timd2_7
cagaagcatcaatatcagca

SEQ ID NO: 60427 - DNA, 20 bp, Artificial Sequence
  sgRNA
  Timd2_8
aggtgtgtcgaataaataca

SEQ ID NO: 60428 - DNA, 20 bp, Artificial Sequence
  sgRNA
  Timd2_9
tgtatttattcgacacacct

SEQ ID NO: 60429 - DNA, 20 bp, Artificial Sequence
  sgRNA
  Timd2_10
atttattcgacacaccttgg

SEQ ID NO: 60430 - DNA, 20 bp, Artificial Sequence
  sgRNA
  Timd2_11
gtgaccgtatacaataagaa

SEQ ID NO: 60431 - DNA, 20 bp, Artificial Sequence
  sgRNA
  Timd2_12
aagaatggcggcattcccct

SEQ ID NO: 60432 - DNA, 20 bp, Artificial Sequence
  sgRNA
  Timd2_13
tcctatgtgttggggcctag

SEQ ID NO: 60433 - DNA, 20 bp, Artificial Sequence
  sgRNA
  Timd2_14
gacatcctcagatgaccctt

SEQ ID NO: 60434 - DNA, 20 bp, Artificial Sequence
  sgRNA
  Timd2_15
ccacagaaaaacctgaataa

SEQ ID NO: 60435 - DNA, 20 bp, Artificial Sequence
  sgRNA
  Timd2_16
agtctcatacagcagtgcag

SEQ ID NO: 60436 - DNA, 20 bp, Artificial Sequence
  sgRNA
  Timd2_17
atgtgtgaccgtatatccat

SEQ ID NO: 60437 - DNA, 20 bp, Artificial Sequence
  sgRNA
  Timd2_18
tgctgtgtagtggagatacc

SEQ ID NO: 60438 - DNA, 20 bp, Artificial Sequence
  sgRNA
  Timd2_19
cccccaaaaaagtggtcgaa

SEQ ID NO: 60439 - DNA, 20 bp, Artificial Sequence
  sgRNA
  Timd2_20
tggtccctattgctgtgtag

SEQ ID NO: 60440 - DNA, 20 bp, Artificial Sequence
  sgRNA
  Timd4_1
accatctcaaacaccaatcg

SEQ ID NO: 60441 - DNA, 20 bp, Artificial Sequence
  sgRNA
  Timd4_2
ggtggttgggagaacagatg

SEQ ID NO: 60442 - DNA, 20 bp, Artificial Sequence
  sgRNA
  Timd4_3
gaccacgagaggtaatgaca

SEQ ID NO: 60443 - DNA, 20 bp, Artificial Sequence
  sgRNA
  Timd4_4
aggtgttgttgaggggcacg

SEQ ID NO: 60444 - DNA, 20 bp, Artificial Sequence
  sgRNA
  Timd4_5
ggtgtactgctgccgtatag

SEQ ID NO: 60445 - DNA, 20 bp, Artificial Sequence
  sgRNA
  Timd4_6
acaccaatcgaggtgacagt

SEQ ID NO: 60446 - DNA, 20 bp, Artificial Sequence
  sgRNA
  Timd4_7
tctcacaagaaaccacaaaa

SEQ ID NO: 60447 - DNA, 20 bp, Artificial Sequence
  sgRNA
  Timd4_8
caatgacatgtcacacggga

SEQ ID NO: 60448 - DNA, 20 bp, Artificial Sequence
  sgRNA
  Timd4_9
ctacagacatagccgtactc

SEQ ID NO: 60449 - DNA, 20 bp, Artificial Sequence
  sgRNA
  Timd4_10
ggtggtggtggtcacataag

SEQ ID NO: 60450 - DNA, 20 bp, Artificial Sequence
  sgRNA
  Timd4_11
tcaatgacatgtcacacggg

SEQ ID NO: 60451 - DNA, 20 bp, Artificial Sequence
  sgRNA
  Timd4_12
agagctccgtcaccagccag

SEQ ID NO: 60452 - DNA, 20 bp, Artificial Sequence
  sgRNA
  Timd4_13
gctccgtcaccagccagagg

SEQ ID NO: 60453 - DNA, 20 bp, Artificial Sequence
  sgRNA
  Timd4_14
acgtgcccctcaacaacacc

SEQ ID NO: 60454 - DNA, 20 bp, Artificial Sequence
  sgRNA
  Timd4_15
aagtggatgggagaatccca

SEQ ID NO: 60455 - DNA, 20 bp, Artificial Sequence
  sgRNA
  Timd4_16
cttgtgtctctgcaaacagt

SEQ ID NO: 60456 - DNA, 20 bp, Artificial Sequence
  sgRNA
  Timd4_17
gcagagcttctccgtacaga

SEQ ID NO: 60457 - DNA, 20 bp, Artificial Sequence
  sgRNA
  Timd4_18
gacaaggcaaagtcaccggc

SEQ ID NO: 60458 - DNA, 20 bp, Artificial Sequence
  sgRNA
  Timd4_19
ggtggtggtcacataagggg

SEQ ID NO: 60459 - DNA, 20 bp, Artificial Sequence
  sgRNA
  Timd4_20
tgccccagcacatactgttg

SEQ ID NO: 60460 - DNA, 20 bp, Artificial Sequence
  sgRNA
  Tlr1_1
taacgtgccgaagagattcg

SEQ ID NO: 60461 - DNA, 20 bp, Artificial Sequence
  sgRNA
  Tlr1_2
tactgtatatgtaactttgg

SEQ ID NO: 60462 - DNA, 20 bp, Artificial Sequence
  sgRNA
  Tlr1_3
tgaacaatgtggaaacaacg

SEQ ID NO: 60463 - DNA, 20 bp, Artificial Sequence
  sgRNA
  Tlr1_4
gcttgaggctgactgttggg

SEQ ID NO: 60464 - DNA, 20 bp, Artificial Sequence
  sgRNA
  Tlr1_5
gcgtatgccaaactatctgg

SEQ ID NO: 60465 - DNA, 20 bp, Artificial Sequence
  sgRNA
  Tlr1_6
gtgtccgtcagcactacgat

SEQ ID NO: 60466 - DNA, 20 bp, Artificial Sequence
  sgRNA
  Tlr1_7
tctaaagtagttgtttgcaa

SEQ ID NO: 60467 - DNA, 20 bp, Artificial Sequence
  sgRNA
  Tlr1_8
tcaaaactctcatgtcacga

SEQ ID NO: 60468 - DNA, 20 bp, Artificial Sequence
  sgRNA
  Tlr1_9
cgttgtttccacattgttca

SEQ ID NO: 60469 - DNA, 20 bp, Artificial Sequence
  sgRNA
  Tlr1_10
aatgtgagcttatcataaag

SEQ ID NO: 60470 - DNA, 20 bp, Artificial Sequence
  sgRNA
  Tlr1_11
aagtgtgtgcttgaagacca

SEQ ID NO: 60471 - DNA, 20 bp, Artificial Sequence
  sgRNA
  Tlr1_12
tgagcttgtggtaattggta

SEQ ID NO: 60472 - DNA, 20 bp, Artificial Sequence
  sgRNA
  Tlr1_13
gctaacgtgccgaagagatt

SEQ ID NO: 60473 - DNA, 20 bp, Artificial Sequence
  sgRNA
  Tlr1_14
tcaaggaccttgactttggg

SEQ ID NO: 60474 - DNA, 20 bp, Artificial Sequence
  sgRNA
  Tlr1_15
gaaatgggctaacttgggac

SEQ ID NO: 60475 - DNA, 20 bp, Artificial Sequence
  sgRNA
  Tlr1_16
aattctctaaggtacagcga

SEQ ID NO: 60476 - DNA, 20 bp, Artificial Sequence
  sgRNA
  Tlr1_17
ccctcagcttggacaatgag

SEQ ID NO: 60477 - DNA, 20 bp, Artificial Sequence
  sgRNA
  Tlr1_18
tgtaacacgttccttctgcc

SEQ ID NO: 60478 - DNA, 20 bp, Artificial Sequence
  sgRNA
  Tlr1_19
actctggtaaggtttgcgtt

SEQ ID NO: 60479 - DNA, 20 bp, Artificial Sequence
  sgRNA
  Tlr1_20
tcaaccccaggaactgtagt

SEQ ID NO: 60480 - DNA, 20 bp, Artificial Sequence
  sgRNA
  Tlr2_1
tcactacgtctgactccgag

SEQ ID NO: 60481 - DNA, 20 bp, Artificial Sequence
  sgRNA
  Tlr2_2
ggaggttcgcacacgctcgg

SEQ ID NO: 60482 - DNA, 20 bp, Artificial Sequence
  sgRNA
  Tlr2_3
ggaaaggggcccgaaccagg

SEQ ID NO: 60483 - DNA, 20 bp, Artificial Sequence
  sgRNA
  Tlr2_4
cagggaacaacgaagcatct

SEQ ID NO: 60484 - DNA, 20 bp, Artificial Sequence
  sgRNA
  Tlr2_5
gctcggcgatttcaacccct

SEQ ID NO: 60485 - DNA, 20 bp, Artificial Sequence
  sgRNA
  Tlr2_6
tagaaacagtcactatccgg

SEQ ID NO: 60486 - DNA, 20 bp, Artificial Sequence
  sgRNA
  Tlr2_7
atgaagaagctggcattccg

SEQ ID NO: 60487 - DNA, 20 bp, Artificial Sequence
  sgRNA
  Tlr2_8
tggtgacattccaagacgga

SEQ ID NO: 60488 - DNA, 20 bp, Artificial Sequence
  sgRNA
  Tlr2_9
gtccagtacagggatccggg

SEQ ID NO: 60489 - DNA, 20 bp, Artificial Sequence
  sgRNA
  Tlr2_10
atggctgctgtgagtccgga

SEQ ID NO: 60490 - DNA, 20 bp, Artificial Sequence
  sgRNA
  Tlr2_11
agaacttcgtacggagcgag

SEQ ID NO: 60491 - DNA, 20 bp, Artificial Sequence
  sgRNA
  Tlr2_12
atatagagctcttgcagccg

SEQ ID NO: 60492 - DNA, 20 bp, Artificial Sequence
  sgRNA
  Tlr2_13
ttctcaggtaccacagtccg

SEQ ID NO: 60493 - DNA, 20 bp, Artificial Sequence
  sgRNA
  Tlr2_14
gcgtctccatagtaaaggat

SEQ ID NO: 60494 - DNA, 20 bp, Artificial Sequence
  sgRNA
  Tlr2_15
tgacctctcttgacatcagc

SEQ ID NO: 60495 - DNA, 20 bp, Artificial Sequence
  sgRNA
  Tlr2_16
acttcaacatcagaacctgg

SEQ ID NO: 60496 - DNA, 20 bp, Artificial Sequence
  sgRNA
  Tlr2_17
tcgacgactgtaccctcaat

SEQ ID NO: 60497 - DNA, 20 bp, Artificial Sequence
  sgRNA
  Tlr2_18
agcagaatcaatacaataga

SEQ ID NO: 60498 - DNA, 20 bp, Artificial Sequence
  sgRNA
  Tlr2_19
ttacatcttggaactgtcgg

SEQ ID NO: 60499 - DNA, 20 bp, Artificial Sequence
  sgRNA
  Tlr2_20
tcatagcaaacgtccctgca

SEQ ID NO: 60500 - DNA, 20 bp, Artificial Sequence
  sgRNA
  Tlr3_1
cttagatgaaatcccagtcg

SEQ ID NO: 60501 - DNA, 20 bp, Artificial Sequence
  sgRNA
  Tlr3_2
gttgtaggaaagatcgagct

SEQ ID NO: 60502 - DNA, 20 bp, Artificial Sequence
  sgRNA
  Tlr3_3
gaatggtcaagttacgaaga

SEQ ID NO: 60503 - DNA, 20 bp, Artificial Sequence
  sgRNA
  Tlr3_4
atctacaaagttgggaacgg

SEQ ID NO: 60504 - DNA, 20 bp, Artificial Sequence
  sgRNA
  Tlr3_5
gtactgctcattcacatcga

SEQ ID NO: 60505 - DNA, 20 bp, Artificial Sequence
  sgRNA
  Tlr3_6
gagtccataaaaagagcgag

SEQ ID NO: 60506 - DNA, 20 bp, Artificial Sequence
  sgRNA
  Tlr3_7
cgttgtatctcacagtgcat

SEQ ID NO: 60507 - DNA, 20 bp, Artificial Sequence
  sgRNA
  Tlr3_8
ggaaattaacgggaccaccg

SEQ ID NO: 60508 - DNA, 20 bp, Artificial Sequence
  sgRNA
  Tlr3_9
ctttcacacgtgcagtcgaa

SEQ ID NO: 60509 - DNA, 20 bp, Artificial Sequence
  sgRNA
  Tlr3_10
aattgtctggaaacaccccg

SEQ ID NO: 60510 - DNA, 20 bp, Artificial Sequence
  sgRNA
  Tlr3_11
agagtccataaaaagagcga

SEQ ID NO: 60511 - DNA, 20 bp, Artificial Sequence
  sgRNA
  Tlr3_12
gtatgtgtgttagcttcaaa

SEQ ID NO: 60512 - DNA, 20 bp, Artificial Sequence
  sgRNA
  Tlr3_13
tggtcaagttacgaagaggg

SEQ ID NO: 60513 - DNA, 20 bp, Artificial Sequence
  sgRNA
  Tlr3_14
tggtcccgttaatttcctga

SEQ ID NO: 60514 - DNA, 20 bp, Artificial Sequence
  sgRNA
  Tlr3_15
aaccgttgccgacatcatgg

SEQ ID NO: 60515 - DNA, 20 bp, Artificial Sequence
  sgRNA
  Tlr3_16
gttcttcacttcgcaacgca

SEQ ID NO: 60516 - DNA, 20 bp, Artificial Sequence
  sgRNA
  Tlr3_17
aggaaattaacgggaccacc

SEQ ID NO: 60517 - DNA, 20 bp, Artificial Sequence
  sgRNA
  Tlr3_18
tgatgtatcgaaaagcttca

SEQ ID NO: 60518 - DNA, 20 bp, Artificial Sequence
  sgRNA
  Tlr3_19
atgtatcgaaaagcttcagg

SEQ ID NO: 60519 - DNA, 20 bp, Artificial Sequence
  sgRNA
  Tlr3_20
ttgctaagagcagttcttgg

SEQ ID NO: 60520 - DNA, 20 bp, Artificial Sequence
  sgRNA
  Tlr4_1
attctcccaagatcaaccga

SEQ ID NO: 60521 - DNA, 20 bp, Artificial Sequence
  sgRNA
  Tlr4_2
tctgacgaacctagtacatg

SEQ ID NO: 60522 - DNA, 20 bp, Artificial Sequence
  sgRNA
  Tlr4_3
cagaaacattcgccaagcaa

SEQ ID NO: 60523 - DNA, 20 bp, Artificial Sequence
  sgRNA
  Tlr4_4
tcagtatcaagtttgagagg

SEQ ID NO: 60524 - DNA, 20 bp, Artificial Sequence
  sgRNA
  Tlr4_5
ggatctttctaaatgtcaat

SEQ ID NO: 60525 - DNA, 20 bp, Artificial Sequence
  sgRNA
  Tlr4_6
tgttaacctgaactcatcaa

SEQ ID NO: 60526 - DNA, 20 bp, Artificial Sequence
  sgRNA
  Tlr4_7
gtccatgccaaccttcgagg

SEQ ID NO: 60527 - DNA, 20 bp, Artificial Sequence
  sgRNA
  Tlr4_8
tcagcactctactttaaaaa

SEQ ID NO: 60528 - DNA, 20 bp, Artificial Sequence
  sgRNA
  Tlr4_9
ctgtcagtatcaagtttgag

SEQ ID NO: 60529 - DNA, 20 bp, Artificial Sequence
  sgRNA
  Tlr4_10
aatcgcatagagacatctaa

SEQ ID NO: 60530 - DNA, 20 bp, Artificial Sequence
  sgRNA
  Tlr4_11
catagtccttccatgataga

SEQ ID NO: 60531 - DNA, 20 bp, Artificial Sequence
  sgRNA
  Tlr4_12
tagtccagagaaacttcctg

SEQ ID NO: 60532 - DNA, 20 bp, Artificial Sequence
  sgRNA
  Tlr4_13
cagaagatgtgcctccccag

SEQ ID NO: 60533 - DNA, 20 bp, Artificial Sequence
  sgRNA
  Tlr4_14
catattcaaagatacaccaa

SEQ ID NO: 60534 - DNA, 20 bp, Artificial Sequence
  sgRNA
  Tlr4_15
tggctggtttacacgtccat

SEQ ID NO: 60535 - DNA, 20 bp, Artificial Sequence
  sgRNA
  Tlr4_16
gacactttattcagagccgt

SEQ ID NO: 60536 - DNA, 20 bp, Artificial Sequence
  sgRNA
  Tlr4_17
taataattgaagtctatgga

SEQ ID NO: 60537 - DNA, 20 bp, Artificial Sequence
  sgRNA
  Tlr4_18
tctatgttcttggttgaaga

SEQ ID NO: 60538 - DNA, 20 bp, Artificial Sequence
  sgRNA
  Tlr4_19
gatctactcgagtcagaatg

SEQ ID NO: 60539 - DNA, 20 bp, Artificial Sequence
  sgRNA
  Tlr4_20
gtatcaggtgaaaatagaag

SEQ ID NO: 60540 - DNA, 20 bp, Artificial Sequence
  sgRNA
  Tlr5_1
agggagatattaccaacacg

SEQ ID NO: 60541 - DNA, 20 bp, Artificial Sequence
  sgRNA
  Tlr5_2
ttctaagcttgggttctccg

SEQ ID NO: 60542 - DNA, 20 bp, Artificial Sequence
  sgRNA
  Tlr5_3
ctgcaactggacctttcgca

SEQ ID NO: 60543 - DNA, 20 bp, Artificial Sequence
  sgRNA
  Tlr5_4
ggaaaactttagggaccgca

SEQ ID NO: 60544 - DNA, 20 bp, Artificial Sequence
  sgRNA
  Tlr5_5
agaaagagacttcattccgg

SEQ ID NO: 60545 - DNA, 20 bp, Artificial Sequence
  sgRNA
  Tlr5_6
tggtttctcgataaactctc

SEQ ID NO: 60546 - DNA, 20 bp, Artificial Sequence
  sgRNA
  Tlr5_7
ctaacttgaccattggtcca

SEQ ID NO: 60547 - DNA, 20 bp, Artificial Sequence
  sgRNA
  Tlr5_8
tcctcaatactaccactgag

SEQ ID NO: 60548 - DNA, 20 bp, Artificial Sequence
  sgRNA
  Tlr5_9
aggtcgttaaatatcccagg

SEQ ID NO: 60549 - DNA, 20 bp, Artificial Sequence
  sgRNA
  Tlr5_10
ttcagtgtcccaaacagtcg

SEQ ID NO: 60550 - DNA, 20 bp, Artificial Sequence
  sgRNA
  Tlr5_11
gatgaactcgagcctctgca

SEQ ID NO: 60551 - DNA, 20 bp, Artificial Sequence
  sgRNA
  Tlr5_12
cttcaactatatcagtatgg

SEQ ID NO: 60552 - DNA, 20 bp, Artificial Sequence
  sgRNA
  Tlr5_13
ccaggcaccaaccatccttc

SEQ ID NO: 60553 - DNA, 20 bp, Artificial Sequence
  sgRNA
  Tlr5_14
ctagcctcacgcctctgaag

SEQ ID NO: 60554 - DNA, 20 bp, Artificial Sequence
  sgRNA
  Tlr5_15
gttcctttgaaggtcaacgt

SEQ ID NO: 60555 - DNA, 20 bp, Artificial Sequence
  sgRNA
  Tlr5_16
gagtcaaagtgaccgtgcac

SEQ ID NO: 60556 - DNA, 20 bp, Artificial Sequence
  sgRNA
  Tlr5_17
gtaacctcacccagattccc

SEQ ID NO: 60557 - DNA, 20 bp, Artificial Sequence
  sgRNA
  Tlr5_18
atacagatggtcctcctggg

SEQ ID NO: 60558 - DNA, 20 bp, Artificial Sequence
  sgRNA
  Tlr5_19
ttatgggcttgacagcctcc

SEQ ID NO: 60559 - DNA, 20 bp, Artificial Sequence
  sgRNA
  Tlr5_20
agccccctagcagtgagtta

SEQ ID NO: 60560 - DNA, 20 bp, Artificial Sequence
  sgRNA
  Tlr6_1
gagttatcatataaaaggcg

SEQ ID NO: 60561 - DNA, 20 bp, Artificial Sequence
  sgRNA
  Tlr6_2
gataactgagagaatcgaca

SEQ ID NO: 60562 - DNA, 20 bp, Artificial Sequence
  sgRNA
  Tlr6_3
ttgccaaattccttacacac

SEQ ID NO: 60563 - DNA, 20 bp, Artificial Sequence
  sgRNA
  Tlr6_4
aacatccaaagtttccagag

SEQ ID NO: 60564 - DNA, 20 bp, Artificial Sequence
  sgRNA
  Tlr6_5
atatgacaggacatgcgcct

SEQ ID NO: 60565 - DNA, 20 bp, Artificial Sequence
  sgRNA
  Tlr6_6
gatgcctcaggctcgccata

SEQ ID NO: 60566 - DNA, 20 bp, Artificial Sequence
  sgRNA
  Tlr6_7
tattgaggtactccaccggt

SEQ ID NO: 60567 - DNA, 20 bp, Artificial Sequence
  sgRNA
  Tlr6_8
gcttccgactattaaggcca

SEQ ID NO: 60568 - DNA, 20 bp, Artificial Sequence
  sgRNA
  Tlr6_9
atagcgcctcctttgaaaag

SEQ ID NO: 60569 - DNA, 20 bp, Artificial Sequence
  sgRNA
  Tlr6_10
ctcaagttcattagagaacg

SEQ ID NO: 60570 - DNA, 20 bp, Artificial Sequence
  sgRNA
  Tlr6_11
agacacccctttcatccaca

SEQ ID NO: 60571 - DNA, 20 bp, Artificial Sequence
  sgRNA
  Tlr6_12
tgaactctcatgcatatgac

SEQ ID NO: 60572 - DNA, 20 bp, Artificial Sequence
  sgRNA
  Tlr6_13
ggttgtttctatgtgctgga

SEQ ID NO: 60573 - DNA, 20 bp, Artificial Sequence
  sgRNA
  Tlr6_14
gcacaccatgtggatgaaag

SEQ ID NO: 60574 - DNA, 20 bp, Artificial Sequence
  sgRNA
  Tlr6_15
aagtggaaactccccacgat

SEQ ID NO: 60575 - DNA, 20 bp, Artificial Sequence
  sgRNA
  Tlr6_16
gctgccctatggcgagcctg

SEQ ID NO: 60576 - DNA, 20 bp, Artificial Sequence
  sgRNA
  Tlr6_17
ttcaaaggaggcgctatact

SEQ ID NO: 60577 - DNA, 20 bp, Artificial Sequence
  sgRNA
  Tlr6_18
gtgagttatcatataaaagg

SEQ ID NO: 60578 - DNA, 20 bp, Artificial Sequence
  sgRNA
  Tlr6_19
gttgcagaggctatcccaga

SEQ ID NO: 60579 - DNA, 20 bp, Artificial Sequence
  sgRNA
  Tlr6_20
tgcgggctctcatggcacag

SEQ ID NO: 60580 - DNA, 20 bp, Artificial Sequence
  sgRNA
  Tlr7_1
tatgggacattataacatcg

SEQ ID NO: 60581 - DNA, 20 bp, Artificial Sequence
  sgRNA
  Tlr7_2
attgtgtacctgttctactg

SEQ ID NO: 60582 - DNA, 20 bp, Artificial Sequence
  sgRNA
  Tlr7_3
aagtaccgcaactctctcaa

SEQ ID NO: 60583 - DNA, 20 bp, Artificial Sequence
  sgRNA
  Tlr7_4
aacattgaaacactctacct

SEQ ID NO: 60584 - DNA, 20 bp, Artificial Sequence
  sgRNA
  Tlr7_5
tccgatacgatgaatatgca

SEQ ID NO: 60585 - DNA, 20 bp, Artificial Sequence
  sgRNA
  Tlr7_6
acatctctacttcggccagc

SEQ ID NO: 60586 - DNA, 20 bp, Artificial Sequence
  sgRNA
  Tlr7_7
gcatttgacagaaatccctg

SEQ ID NO: 60587 - DNA, 20 bp, Artificial Sequence
  sgRNA
  Tlr7_8
gtaagattggtggtgttagt

SEQ ID NO: 60588 - DNA, 20 bp, Artificial Sequence
  sgRNA
  Tlr7_9
gtatcagcatctgcaatcca

SEQ ID NO: 60589 - DNA, 20 bp, Artificial Sequence
  sgRNA
  Tlr7_10
ctagagtctttgggtttcga

SEQ ID NO: 60590 - DNA, 20 bp, Artificial Sequence
  sgRNA
  Tlr7_11
aagccaatgtgtgtaccaag

SEQ ID NO: 60591 - DNA, 20 bp, Artificial Sequence
  sgRNA
  Tlr7_12
gcattgtcatggatctgtaa

SEQ ID NO: 60592 - DNA, 20 bp, Artificial Sequence
  sgRNA
  Tlr7_13
tgtgcagtccacgatcacat

SEQ ID NO: 60593 - DNA, 20 bp, Artificial Sequence
  sgRNA
  Tlr7_14
tgaaaattctgcgtgtcaag

SEQ ID NO: 60594 - DNA, 20 bp, Artificial Sequence
  sgRNA
  Tlr7_15
atatttactttaacttcaca

SEQ ID NO: 60595 - DNA, 20 bp, Artificial Sequence
  sgRNA
  Tlr7_16
tagagctctagtaaattagg

SEQ ID NO: 60596 - DNA, 20 bp, Artificial Sequence
  sgRNA
  Tlr7_17
gagagattctttagatttgg

SEQ ID NO: 60597 - DNA, 20 bp, Artificial Sequence
  sgRNA
  Tlr7_18
ataagccacatgattgtctg

SEQ ID NO: 60598 - DNA, 20 bp, Artificial Sequence
  sgRNA
  Tlr7_19
agacctctcccaaaactact

SEQ ID NO: 60599 - DNA, 20 bp, Artificial Sequence
  sgRNA
  Tlr7_20
gggagaggtctagttcctgg

SEQ ID NO: 60600 - DNA, 20 bp, Artificial Sequence
  sgRNA
  Tlr8_1
agttcaagaaattgcctcgg

SEQ ID NO: 60601 - DNA, 20 bp, Artificial Sequence
  sgRNA
  Tlr8_2
ctccaagagttacttatcag

SEQ ID NO: 60602 - DNA, 20 bp, Artificial Sequence
  sgRNA
  Tlr8_3
tactgaaatagtgtgcattg

SEQ ID NO: 60603 - DNA, 20 bp, Artificial Sequence
  sgRNA
  Tlr8_4
aacttggcaaccatcaactt

SEQ ID NO: 60604 - DNA, 20 bp, Artificial Sequence
  sgRNA
  Tlr8_5
ccgaagacgatttcgccaag

SEQ ID NO: 60605 - DNA, 20 bp, Artificial Sequence
  sgRNA
  Tlr8_6
cctcttggcgaaatcgtctt

SEQ ID NO: 60606 - DNA, 20 bp, Artificial Sequence
  sgRNA
  Tlr8_7
agatctcacgacttgtgtat

SEQ ID NO: 60607 - DNA, 20 bp, Artificial Sequence
  sgRNA
  Tlr8_8
ggctcaggtttaacaccctg

SEQ ID NO: 60608 - DNA, 20 bp, Artificial Sequence
  sgRNA
  Tlr8_9
ccagattcctggcttcggag

SEQ ID NO: 60609 - DNA, 20 bp, Artificial Sequence
  sgRNA
  Tlr8_10
gcaaacttagataggcaatt

SEQ ID NO: 60610 - DNA, 20 bp, Artificial Sequence
  sgRNA
  Tlr8_11
agttatatactatacctgct

SEQ ID NO: 60611 - DNA, 20 bp, Artificial Sequence
  sgRNA
  Tlr8_12
agtacctgaggcttcggcag

SEQ ID NO: 60612 - DNA, 20 bp, Artificial Sequence
  sgRNA
  Tlr8_13
gtaaaactgttagatttctt

SEQ ID NO: 60613 - DNA, 20 bp, Artificial Sequence
  sgRNA
  Tlr8_14
ttaacattactagatctgag

SEQ ID NO: 60614 - DNA, 20 bp, Artificial Sequence
  sgRNA
  Tlr8_15
tcaggacgattccttctacc

SEQ ID NO: 60615 - DNA, 20 bp, Artificial Sequence
  sgRNA
  Tlr8_16
aatggagcattgtaacacct

SEQ ID NO: 60616 - DNA, 20 bp, Artificial Sequence
  sgRNA
  Tlr8_17
agttctggataaatcctaga

SEQ ID NO: 60617 - DNA, 20 bp, Artificial Sequence
  sgRNA
  Tlr8_18
ctttctacttggccttgcag

SEQ ID NO: 60618 - DNA, 20 bp, Artificial Sequence
  sgRNA
  Tlr8_19
tcttgactgaaaatgattca

SEQ ID NO: 60619 - DNA, 20 bp, Artificial Sequence
  sgRNA
  Tlr8_20
caaaatcatgaacatcactc

SEQ ID NO: 60620 - DNA, 20 bp, Artificial Sequence
  sgRNA
  Tlr9_1
aagataggtagttgtctcgg

SEQ ID NO: 60621 - DNA, 20 bp, Artificial Sequence
  sgRNA
  Tlr9_2
gcaggctgtataggccggcg

SEQ ID NO: 60622 - DNA, 20 bp, Artificial Sequence
  sgRNA
  Tlr9_3
acattctatacagggattgg

SEQ ID NO: 60623 - DNA, 20 bp, Artificial Sequence
  sgRNA
  Tlr9_4
tctctggcttgatagtcacc

SEQ ID NO: 60624 - DNA, 20 bp, Artificial Sequence
  sgRNA
  Tlr9_5
tgccttatcgaacaccacga

SEQ ID NO: 60625 - DNA, 20 bp, Artificial Sequence
  sgRNA
  Tlr9_6
acaccacgaaggcatcataa

SEQ ID NO: 60626 - DNA, 20 bp, Artificial Sequence
  sgRNA
  Tlr9_7
actgggtgtataacgagctg

SEQ ID NO: 60627 - DNA, 20 bp, Artificial Sequence
  sgRNA
  Tlr9_8
cagctcgttatacacccagt

SEQ ID NO: 60628 - DNA, 20 bp, Artificial Sequence
  sgRNA
  Tlr9_9
tataaccagaacttctgccg

SEQ ID NO: 60629 - DNA, 20 bp, Artificial Sequence
  sgRNA
  Tlr9_10
ggtcctccagacacaagcgt

SEQ ID NO: 60630 - DNA, 20 bp, Artificial Sequence
  sgRNA
  Tlr9_11
gttggaagaccgcaaggacg

SEQ ID NO: 60631 - DNA, 20 bp, Artificial Sequence
  sgRNA
  Tlr9_12
tcgtccacctgtccaacctg

SEQ ID NO: 60632 - DNA, 20 bp, Artificial Sequence
  sgRNA
  Tlr9_13
agcacctgcagattagtcag

SEQ ID NO: 60633 - DNA, 20 bp, Artificial Sequence
  sgRNA
  Tlr9_14
acccacatcaagtactcgaa

SEQ ID NO: 60634 - DNA, 20 bp, Artificial Sequence
  sgRNA
  Tlr9_15
cctatactgcaccatctctg

SEQ ID NO: 60635 - DNA, 20 bp, Artificial Sequence
  sgRNA
  Tlr9_16
gcgcctgttggaagaccgca

SEQ ID NO: 60636 - DNA, 20 bp, Artificial Sequence
  sgRNA
  Tlr9_17
gacacaagcgtagggctcgg

SEQ ID NO: 60637 - DNA, 20 bp, Artificial Sequence
  sgRNA
  Tlr9_18
cagccacaacattctcaaga

SEQ ID NO: 60638 - DNA, 20 bp, Artificial Sequence
  sgRNA
  Tlr9_19
gctcaggctcagattcacca

SEQ ID NO: 60639 - DNA, 20 bp, Artificial Sequence
  sgRNA
  Tlr9_20
ataacctcattgtcaagctg

SEQ ID NO: 60640 - DNA, 20 bp, Artificial Sequence
  sgRNA
  Tm4sf1_1
tgctgcggctacgaaaacta

SEQ ID NO: 60641 - DNA, 20 bp, Artificial Sequence
  sgRNA
  Tm4sf1_2
atcccaatgaacacaaacgc

SEQ ID NO: 60642 - DNA, 20 bp, Artificial Sequence
  sgRNA
  Tm4sf1_3
ggagacaaagtatgctacgg

SEQ ID NO: 60643 - DNA, 20 bp, Artificial Sequence
  sgRNA
  Tm4sf1_4
ggtgtagttccatactccat

SEQ ID NO: 60644 - DNA, 20 bp, Artificial Sequence
  sgRNA
  Tm4sf1_5
gctttgctctactttcctaa

SEQ ID NO: 60645 - DNA, 20 bp, Artificial Sequence
  sgRNA
  Tm4sf1_6
acacaagatgaattcaactg

SEQ ID NO: 60646 - DNA, 20 bp, Artificial Sequence
  sgRNA
  Tm4sf1_7
atagcacttggaccacatag

SEQ ID NO: 60647 - DNA, 20 bp, Artificial Sequence
  sgRNA
  Tm4sf1_8
ccatgggcatcgctgcactt

SEQ ID NO: 60648 - DNA, 20 bp, Artificial Sequence
  sgRNA
  Tm4sf1_9
tgccactccacaatatgctt

SEQ ID NO: 60649 - DNA, 20 bp, Artificial Sequence
  sgRNA
  Tm4sf1_10
agcccaagcatattgtggag

SEQ ID NO: 60650 - DNA, 20 bp, Artificial Sequence
  sgRNA
  Tm4sf1_11
tttgccggcattgtaggcgg

SEQ ID NO: 60651 - DNA, 20 bp, Artificial Sequence
  sgRNA
  Tm4sf1_12
aataccacacgaaacggctg

SEQ ID NO: 60652 - DNA, 20 bp, Artificial Sequence
  sgRNA
  Tm4sf1_13
gctgctctgattggaatcgt

SEQ ID NO: 60653 - DNA, 20 bp, Artificial Sequence
  sgRNA
  Tm4sf1_14
catcggatactctctggtgt

SEQ ID NO: 60654 - DNA, 20 bp, Artificial Sequence
  sgRNA
  Tm4sf1_15
gtaaagtgtgcaagatacat

SEQ ID NO: 60655 - DNA, 20 bp, Artificial Sequence
  sgRNA
  Tm4sf1_16
gtaataaatggaatgcttgg

SEQ ID NO: 60656 - DNA, 20 bp, Artificial Sequence
  sgRNA
  Tm4sf1_17
ccaaagtgcagcgatgccca

SEQ ID NO: 60657 - DNA, 20 bp, Artificial Sequence
  sgRNA
  Tm4sf1_18
atggatgaagaggactgctg

SEQ ID NO: 60658 - DNA, 20 bp, Artificial Sequence
  sgRNA
  Tm4sf1_19
accacatagaggaattcaga

SEQ ID NO: 60659 - DNA, 20 bp, Artificial Sequence
  sgRNA
  Tm4sf1_20
caactgcggcaaaagccaag

SEQ ID NO: 60660 - DNA, 20 bp, Artificial Sequence
  sgRNA
  Tm4sf20_1
cctgggaatcagcttagtgg

SEQ ID NO: 60661 - DNA, 20 bp, Artificial Sequence
  sgRNA
  Tm4sf20_2
gtgctgcaacaataagactg

SEQ ID NO: 60662 - DNA, 20 bp, Artificial Sequence
  sgRNA
  Tm4sf20_3
cattctgatcctgctaggag

SEQ ID NO: 60663 - DNA, 20 bp, Artificial Sequence
  sgRNA
  Tm4sf20_4
ttcacaagtgacagtactgt

SEQ ID NO: 60664 - DNA, 20 bp, Artificial Sequence
  sgRNA
  Tm4sf20_5
gggctcagtcagatactcat

SEQ ID NO: 60665 - DNA, 20 bp, Artificial Sequence
  sgRNA
  Tm4sf20_6
tgtgtggcgtctctcagcga

SEQ ID NO: 60666 - DNA, 20 bp, Artificial Sequence
  sgRNA
  Tm4sf20_7
tccactaagctgattcccag

SEQ ID NO: 60667 - DNA, 20 bp, Artificial Sequence
  sgRNA
  Tm4sf20_8
gtatctgactgagcccaaac

SEQ ID NO: 60668 - DNA, 20 bp, Artificial Sequence
  sgRNA
  Tm4sf20_9
gcctgagtattacaaattag

SEQ ID NO: 60669 - DNA, 20 bp, Artificial Sequence
  sgRNA
  Tm4sf20_10
cgtgctgcaacaataagact

SEQ ID NO: 60670 - DNA, 20 bp, Artificial Sequence
  sgRNA
  Tm4sf20_11
tggaaaccaccactcatagc

SEQ ID NO: 60671 - DNA, 20 bp, Artificial Sequence
  sgRNA
  Tm4sf20_12
gcgtgctgcaacaataagac

SEQ ID NO: 60672 - DNA, 20 bp, Artificial Sequence
  sgRNA
  Tm4sf20_13
gtgtctgtcttcttcagagt

SEQ ID NO: 60673 - DNA, 20 bp, Artificial Sequence
  sgRNA
  Tm4sf20_14
gctccaggattccaacaagc

SEQ ID NO: 60674 - DNA, 20 bp, Artificial Sequence
  sgRNA
  Tm4sf20_15
ctgaatccttcaatctgctg

SEQ ID NO: 60675 - DNA, 20 bp, Artificial Sequence
  sgRNA
  Tm4sf20_16
ccatctcctgctatgagtgg

SEQ ID NO: 60676 - DNA, 20 bp, Artificial Sequence
  sgRNA
  Tm4sf20_17
ctgaccatgttattgatggt

SEQ ID NO: 60677 - DNA, 20 bp, Artificial Sequence
  sgRNA
  Tm4sf20_18
gaagaaccacagcagattga

SEQ ID NO: 60678 - DNA, 20 bp, Artificial Sequence
  sgRNA
  Tm4sf20_19
ccaaggacattgttgttgct

SEQ ID NO: 60679 - DNA, 20 bp, Artificial Sequence
  sgRNA
  Tm4sf20_20
ctagcaggatcagaatgagc

SEQ ID NO: 60680 - DNA, 20 bp, Artificial Sequence
  sgRNA
  Tm4sf4_1
gatgaggtctggtacttcgg

SEQ ID NO: 60681 - DNA, 20 bp, Artificial Sequence
  sgRNA
  Tm4sf4_2
tccaatcacagcaaacaacg

SEQ ID NO: 60682 - DNA, 20 bp, Artificial Sequence
  sgRNA
  Tm4sf4_3
acaacaggatatttgccagg

SEQ ID NO: 60683 - DNA, 20 bp, Artificial Sequence
  sgRNA
  Tm4sf4_4
gagccttacccatcgtggaa

SEQ ID NO: 60684 - DNA, 20 bp, Artificial Sequence
  sgRNA
  Tm4sf4_5
ccattctgctggtcatcgga

SEQ ID NO: 60685 - DNA, 20 bp, Artificial Sequence
  sgRNA
  Tm4sf4_6
agtaccagacctcatccgaa

SEQ ID NO: 60686 - DNA, 20 bp, Artificial Sequence
  sgRNA
  Tm4sf4_7
ggtcatcggagggatccaga

SEQ ID NO: 60687 - DNA, 20 bp, Artificial Sequence
  sgRNA
  Tm4sf4_8
tgtgccatccaggtgatcaa

SEQ ID NO: 60688 - DNA, 20 bp, Artificial Sequence
  sgRNA
  Tm4sf4_9
ctccacagagagttcccagg

SEQ ID NO: 60689 - DNA, 20 bp, Artificial Sequence
  sgRNA
  Tm4sf4_10
gaacgacaaaagccaccttt

SEQ ID NO: 60690 - DNA, 20 bp, Artificial Sequence
  sgRNA
  Tm4sf4_11
atcctgttgttctttcctgg

SEQ ID NO: 60691 - DNA, 20 bp, Artificial Sequence
  sgRNA
  Tm4sf4_12
tggggataccccttccacga

SEQ ID NO: 60692 - DNA, 20 bp, Artificial Sequence
  sgRNA
  Tm4sf4_13
accagacctcatccgaaagg

SEQ ID NO: 60693 - DNA, 20 bp, Artificial Sequence
  sgRNA
  Tm4sf4_14
tgaccagcagaatggagaag

SEQ ID NO: 60694 - DNA, 20 bp, Artificial Sequence
  sgRNA
  Tm4sf4_15
aatcacagcaaacaacgtgg

SEQ ID NO: 60695 - DNA, 20 bp, Artificial Sequence
  sgRNA
  Tm4sf4_16
ggcccaagaacacaagcgca

SEQ ID NO: 60696 - DNA, 20 bp, Artificial Sequence
  sgRNA
  Tm4sf4_17
ctgcagaacaacgactgctg

SEQ ID NO: 60697 - DNA, 20 bp, Artificial Sequence
  sgRNA
  Tm4sf4_18
aggaggccaaacacagccag

SEQ ID NO: 60698 - DNA, 20 bp, Artificial Sequence
  sgRNA
  Tm4sf4_19
tcagctgtttctatcaacaa

SEQ ID NO: 60699 - DNA, 20 bp, Artificial Sequence
  sgRNA
  Tm4sf4_20
ccctccgatgaccagcagaa

SEQ ID NO: 60700 - DNA, 20 bp, Artificial Sequence
  sgRNA
  Tm4sf5_1
gctgtgtccaggaattgcag

SEQ ID NO: 60701 - DNA, 20 bp, Artificial Sequence
  sgRNA
  Tm4sf5_2
atgcttaatagacaacaagt

SEQ ID NO: 60702 - DNA, 20 bp, Artificial Sequence
  sgRNA
  Tm4sf5_3
aggtaccagcaggagggcgt

SEQ ID NO: 60703 - DNA, 20 bp, Artificial Sequence
  sgRNA
  Tm4sf5_4
gatggcgccaagcaccccaa

SEQ ID NO: 60704 - DNA, 20 bp, Artificial Sequence
  sgRNA
  Tm4sf5_5
tgatgggaagaccacctgga

SEQ ID NO: 60705 - DNA, 20 bp, Artificial Sequence
  sgRNA
  Tm4sf5_6
gaggttgccgtccgtccagg

SEQ ID NO: 60706 - DNA, 20 bp, Artificial Sequence
  sgRNA
  Tm4sf5_7
atcgccacacaacacaccaa

SEQ ID NO: 60707 - DNA, 20 bp, Artificial Sequence
  sgRNA
  Tm4sf5_8
tgtgctgtgtggaattcagc

SEQ ID NO: 60708 - DNA, 20 bp, Artificial Sequence
  sgRNA
  Tm4sf5_9
gacactcttctcaatcctgg

SEQ ID NO: 60709 - DNA, 20 bp, Artificial Sequence
  sgRNA
  Tm4sf5_10
tgagccaaacttgcaagctg

SEQ ID NO: 60710 - DNA, 20 bp, Artificial Sequence
  sgRNA
  Tm4sf5_11
tacctgatgggaagaccacc

SEQ ID NO: 60711 - DNA, 20 bp, Artificial Sequence
  sgRNA
  Tm4sf5_12
catctactgcctgtcagtgg

SEQ ID NO: 60712 - DNA, 20 bp, Artificial Sequence
  sgRNA
  Tm4sf5_13
gagaagagtgtcacattcca

SEQ ID NO: 60713 - DNA, 20 bp, Artificial Sequence
  sgRNA
  Tm4sf5_14
gggaagaccacctggacgga

SEQ ID NO: 60714 - DNA, 20 bp, Artificial Sequence
  sgRNA
  Tm4sf5_15
gttggccacgatgcagacca

SEQ ID NO: 60715 - DNA, 20 bp, Artificial Sequence
  sgRNA
  Tm4sf5_16
tggcgattgcaggaaaaagg

SEQ ID NO: 60716 - DNA, 20 bp, Artificial Sequence
  sgRNA
  Tm4sf5_17
ccagacttgatgcgaccacc

SEQ ID NO: 60717 - DNA, 20 bp, Artificial Sequence
  sgRNA
  Tm4sf5_18
tcttcccatcaggtaccagc

SEQ ID NO: 60718 - DNA, 20 bp, Artificial Sequence
  sgRNA
  Tm4sf5_19
gcccagctcccgccactgac

SEQ ID NO: 60719 - DNA, 20 bp, Artificial Sequence
  sgRNA
  Tm4sf5_20
cgatgcagaccagggagaga

SEQ ID NO: 60720 - DNA, 20 bp, Artificial Sequence
  sgRNA
  Tm7sf3_1
ctcacagtatcagaatacca

SEQ ID NO: 60721 - DNA, 20 bp, Artificial Sequence
  sgRNA
  Tm7sf3_2
cagcaaacataggctatgca

SEQ ID NO: 60722 - DNA, 20 bp, Artificial Sequence
  sgRNA
  Tm7sf3_3
tactcaccgtcatactgaag

SEQ ID NO: 60723 - DNA, 20 bp, Artificial Sequence
  sgRNA
  Tm7sf3_4
gcccgagggcgacctcaccg

SEQ ID NO: 60724 - DNA, 20 bp, Artificial Sequence
  sgRNA
  Tm7sf3_5
gctctcaacacagatttccg

SEQ ID NO: 60725 - DNA, 20 bp, Artificial Sequence
  sgRNA
  Tm7sf3_6
gctgcgcctgctggtcctag

SEQ ID NO: 60726 - DNA, 20 bp, Artificial Sequence
  sgRNA
  Tm7sf3_7
tctcaacacagatttccgag

SEQ ID NO: 60727 - DNA, 20 bp, Artificial Sequence
  sgRNA
  Tm7sf3_8
gcactctaatgacagcccct

SEQ ID NO: 60728 - DNA, 20 bp, Artificial Sequence
  sgRNA
  Tm7sf3_9
acatcatcctggccgtgtgg

SEQ ID NO: 60729 - DNA, 20 bp, Artificial Sequence
  sgRNA
  Tm7sf3_10
gtaccagtacttcctgcccg

SEQ ID NO: 60730 - DNA, 20 bp, Artificial Sequence
  sgRNA
  Tm7sf3_11
agatgactccttgtcccggg

SEQ ID NO: 60731 - DNA, 20 bp, Artificial Sequence
  sgRNA
  Tm7sf3_12
cattgcttgaaatatggcgc

SEQ ID NO: 60732 - DNA, 20 bp, Artificial Sequence
  sgRNA
  Tm7sf3_13
gatcaaagagctcttccaga

SEQ ID NO: 60733 - DNA, 20 bp, Artificial Sequence
  sgRNA
  Tm7sf3_14
taccagtacttcctgcccga

SEQ ID NO: 60734 - DNA, 20 bp, Artificial Sequence
  sgRNA
  Tm7sf3_15
ggatgtagaagaagaacccc

SEQ ID NO: 60735 - DNA, 20 bp, Artificial Sequence
  sgRNA
  Tm7sf3_16
gccaccatgaagccaccagg

SEQ ID NO: 60736 - DNA, 20 bp, Artificial Sequence
  sgRNA
  Tm7sf3_17
gcaccagccgagagtccagg

SEQ ID NO: 60737 - DNA, 20 bp, Artificial Sequence
  sgRNA
  Tm7sf3_18
ttctgagtaggagagcgtaa

SEQ ID NO: 60738 - DNA, 20 bp, Artificial Sequence
  sgRNA
  Tm7sf3_19
ccataaagcctctctctcag

SEQ ID NO: 60739 - DNA, 20 bp, Artificial Sequence
  sgRNA
  Tm7sf3_20
gcttgaaatatggcgcagga

SEQ ID NO: 60740 - DNA, 20 bp, Artificial Sequence
  sgRNA
  Tm9sf1_1
tatttgccaatgtttcggtg

SEQ ID NO: 60741 - DNA, 20 bp, Artificial Sequence
  sgRNA
  Tm9sf1_2
ccatgtagcccacaaaacca

SEQ ID NO: 60742 - DNA, 20 bp, Artificial Sequence
  sgRNA
  Tm9sf1_3
ggacaaccaatggatttcca

SEQ ID NO: 60743 - DNA, 20 bp, Artificial Sequence
  sgRNA
  Tm9sf1_4
gttcaacgtgcaccgtcacg

SEQ ID NO: 60744 - DNA, 20 bp, Artificial Sequence
  sgRNA
  Tm9sf1_5
tggcgatccgtgctgagcgt

SEQ ID NO: 60745 - DNA, 20 bp, Artificial Sequence
  sgRNA
  Tm9sf1_6
tctagtgacgactttgacca

SEQ ID NO: 60746 - DNA, 20 bp, Artificial Sequence
  sgRNA
  Tm9sf1_7
atgacagtagacttgtacca

SEQ ID NO: 60747 - DNA, 20 bp, Artificial Sequence
  sgRNA
  Tm9sf1_8
gtcgcacaaagaatatcgcc

SEQ ID NO: 60748 - DNA, 20 bp, Artificial Sequence
  sgRNA
  Tm9sf1_9
ggaagtccaaatgtgtccag

SEQ ID NO: 60749 - DNA, 20 bp, Artificial Sequence
  sgRNA
  Tm9sf1_10
gcacggatcgccaccaccag

SEQ ID NO: 60750 - DNA, 20 bp, Artificial Sequence
  sgRNA
  Tm9sf1_11
gtgcgacaaggtgcatcaaa

SEQ ID NO: 60751 - DNA, 20 bp, Artificial Sequence
  sgRNA
  Tm9sf1_12
tcgcacaaagaatatcgccc

SEQ ID NO: 60752 - DNA, 20 bp, Artificial Sequence
  sgRNA
  Tm9sf1_13
ttccgcttccctccataccg

SEQ ID NO: 60753 - DNA, 20 bp, Artificial Sequence
  sgRNA
  Tm9sf1_14
gggaccctaccataaccctc

SEQ ID NO: 60754 - DNA, 20 bp, Artificial Sequence
  sgRNA
  Tm9sf1_15
gtcgatgatttgccaatccg

SEQ ID NO: 60755 - DNA, 20 bp, Artificial Sequence
  sgRNA
  Tm9sf1_16
aatggcagctccaacttcga

SEQ ID NO: 60756 - DNA, 20 bp, Artificial Sequence
  sgRNA
  Tm9sf1_17
ggtggagccgacgctcagca

SEQ ID NO: 60757 - DNA, 20 bp, Artificial Sequence
  sgRNA
  Tm9sf1_18
gcggatctcgtacaaagatt

SEQ ID NO: 60758 - DNA, 20 bp, Artificial Sequence
  sgRNA
  Tm9sf1_19
catcggagtgacaggcgccg

SEQ ID NO: 60759 - DNA, 20 bp, Artificial Sequence
  sgRNA
  Tm9sf1_20
ccggcgctctaacatgtcag

SEQ ID NO: 60760 - DNA, 20 bp, Artificial Sequence
  sgRNA
  Tm9sf2_1
tggataatatgcctgtcacg

SEQ ID NO: 60761 - DNA, 20 bp, Artificial Sequence
  sgRNA
  Tm9sf2_2
atacaaaccttatacggtga

SEQ ID NO: 60762 - DNA, 20 bp, Artificial Sequence
  sgRNA
  Tm9sf2_3
cacacttacactgataacac

SEQ ID NO: 60763 - DNA, 20 bp, Artificial Sequence
  sgRNA
  Tm9sf2_4
ttcttgtcccctgccaatcg

SEQ ID NO: 60764 - DNA, 20 bp, Artificial Sequence
  sgRNA
  Tm9sf2_5
actgctcaggaatctgacga

SEQ ID NO: 60765 - DNA, 20 bp, Artificial Sequence
  sgRNA
  Tm9sf2_6
tcttcggcgcagaagttgac

SEQ ID NO: 60766 - DNA, 20 bp, Artificial Sequence
  sgRNA
  Tm9sf2_7
tggcgttccttccttaccag

SEQ ID NO: 60767 - DNA, 20 bp, Artificial Sequence
  sgRNA
  Tm9sf2_8
aatctgacgagggatctgat

SEQ ID NO: 60768 - DNA, 20 bp, Artificial Sequence
  sgRNA
  Tm9sf2_9
tctccaaactgcagatcacg

SEQ ID NO: 60769 - DNA, 20 bp, Artificial Sequence
  sgRNA
  Tm9sf2_10
atataaccagatggactcta

SEQ ID NO: 60770 - DNA, 20 bp, Artificial Sequence
  sgRNA
  Tm9sf2_11
tgtaatcctggatttcccat

SEQ ID NO: 60771 - DNA, 20 bp, Artificial Sequence
  sgRNA
  Tm9sf2_12
ggttcgaactgggtgttcaa

SEQ ID NO: 60772 - DNA, 20 bp, Artificial Sequence
  sgRNA
  Tm9sf2_13
gcaagtacaatcctgtactt

SEQ ID NO: 60773 - DNA, 20 bp, Artificial Sequence
  sgRNA
  Tm9sf2_14
tcagggctcctcgattggca

SEQ ID NO: 60774 - DNA, 20 bp, Artificial Sequence
  sgRNA
  Tm9sf2_15
tctgtaatgtaacagccaat

SEQ ID NO: 60775 - DNA, 20 bp, Artificial Sequence
  sgRNA
  Tm9sf2_16
cagattccaccgaatcaagc

SEQ ID NO: 60776 - DNA, 20 bp, Artificial Sequence
  sgRNA
  Tm9sf2_17
tattgccagatataaccaga

SEQ ID NO: 60777 - DNA, 20 bp, Artificial Sequence
  sgRNA
  Tm9sf2_18
gcatcccctttcttggagga

SEQ ID NO: 60778 - DNA, 20 bp, Artificial Sequence
  sgRNA
  Tm9sf2_19
cagggctcctcgattggcag

SEQ ID NO: 60779 - DNA, 20 bp, Artificial Sequence
  sgRNA
  Tm9sf2_20
gactgctcaggaatctgacg

SEQ ID NO: 60780 - DNA, 20 bp, Artificial Sequence
  sgRNA
  Tm9sf3_1
ggaagtctgtatgctagaca

SEQ ID NO: 60781 - DNA, 20 bp, Artificial Sequence
  sgRNA
  Tm9sf3_2
gatgttaatctaactagtga

SEQ ID NO: 60782 - DNA, 20 bp, Artificial Sequence
  sgRNA
  Tm9sf3_3
acgagcacgaacacacggtg

SEQ ID NO: 60783 - DNA, 20 bp, Artificial Sequence
  sgRNA
  Tm9sf3_4
atagatgacttaccaatatg

SEQ ID NO: 60784 - DNA, 20 bp, Artificial Sequence
  sgRNA
  Tm9sf3_5
gcacggcattgacacgacaa

SEQ ID NO: 60785 - DNA, 20 bp, Artificial Sequence
  sgRNA
  Tm9sf3_6
tgctcgtcagaccgagcccg

SEQ ID NO: 60786 - DNA, 20 bp, Artificial Sequence
  sgRNA
  Tm9sf3_7
acatccagagccaatgaggg

SEQ ID NO: 60787 - DNA, 20 bp, Artificial Sequence
  sgRNA
  Tm9sf3_8
attgtaccaacgagatttag

SEQ ID NO: 60788 - DNA, 20 bp, Artificial Sequence
  sgRNA
  Tm9sf3_9
gataaagcagatgtttatcg

SEQ ID NO: 60789 - DNA, 20 bp, Artificial Sequence
  sgRNA
  Tm9sf3_10
gctgctacatcgccagtgaa

SEQ ID NO: 60790 - DNA, 20 bp, Artificial Sequence
  sgRNA
  Tm9sf3_11
taaacgcagaggattacagg

SEQ ID NO: 60791 - DNA, 20 bp, Artificial Sequence
  sgRNA
  Tm9sf3_12
cggtgtttagcacagccttg

SEQ ID NO: 60792 - DNA, 20 bp, Artificial Sequence
  sgRNA
  Tm9sf3_13
acagccttggggataatgtg

SEQ ID NO: 60793 - DNA, 20 bp, Artificial Sequence
  sgRNA
  Tm9sf3_14
gtacatgtaaacgtagatcg

SEQ ID NO: 60794 - DNA, 20 bp, Artificial Sequence
  sgRNA
  Tm9sf3_15
tgtaatcctctgcgtttagc

SEQ ID NO: 60795 - DNA, 20 bp, Artificial Sequence
  sgRNA
  Tm9sf3_16
tcaataaagattgatccaaa

SEQ ID NO: 60796 - DNA, 20 bp, Artificial Sequence
  sgRNA
  Tm9sf3_17
agacgagtatggctggaagc

SEQ ID NO: 60797 - DNA, 20 bp, Artificial Sequence
  sgRNA
  Tm9sf3_18
atacttcctgctaaacgcag

SEQ ID NO: 60798 - DNA, 20 bp, Artificial Sequence
  sgRNA
  Tm9sf3_19
gtcccatcccggagaaaaaa

SEQ ID NO: 60799 - DNA, 20 bp, Artificial Sequence
  sgRNA
  Tm9sf3_20
cacagacagtcacaatgcac

SEQ ID NO: 60800 - DNA, 20 bp, Artificial Sequence
  sgRNA
  Tm9sf4_1
gagttcatgtaccctacccg

SEQ ID NO: 60801 - DNA, 20 bp, Artificial Sequence
  sgRNA
  Tm9sf4_2
tccggatgataatcatgctg

SEQ ID NO: 60802 - DNA, 20 bp, Artificial Sequence
  sgRNA
  Tm9sf4_3
accgaactctaaaaggccat

SEQ ID NO: 60803 - DNA, 20 bp, Artificial Sequence
  sgRNA
  Tm9sf4_4
tggcttcacggatgtcaaca

SEQ ID NO: 60804 - DNA, 20 bp, Artificial Sequence
  sgRNA
  Tm9sf4_5
agttcatgtaccctacccga

SEQ ID NO: 60805 - DNA, 20 bp, Artificial Sequence
  sgRNA
  Tm9sf4_6
tcaatgaacatggcaccaaa

SEQ ID NO: 60806 - DNA, 20 bp, Artificial Sequence
  sgRNA
  Tm9sf4_7
tttgtgagcaggacaccacc

SEQ ID NO: 60807 - DNA, 20 bp, Artificial Sequence
  sgRNA
  Tm9sf4_8
catcctttattaccaccggg

SEQ ID NO: 60808 - DNA, 20 bp, Artificial Sequence
  sgRNA
  Tm9sf4_9
gttggcgatgtccttccgca

SEQ ID NO: 60809 - DNA, 20 bp, Artificial Sequence
  sgRNA
  Tm9sf4_10
cccggcagatccctgaacaa

SEQ ID NO: 60810 - DNA, 20 bp, Artificial Sequence
  sgRNA
  Tm9sf4_11
ggaaattcctccaccaccag

SEQ ID NO: 60811 - DNA, 20 bp, Artificial Sequence
  sgRNA
  Tm9sf4_12
gtaggctgcgtagaagccga

SEQ ID NO: 60812 - DNA, 20 bp, Artificial Sequence
  sgRNA
  Tm9sf4_13
tctggggaatcacctcgaag

SEQ ID NO: 60813 - DNA, 20 bp, Artificial Sequence
  sgRNA
  Tm9sf4_14
gtattcttctgtgattcgct

SEQ ID NO: 60814 - DNA, 20 bp, Artificial Sequence
  sgRNA
  Tm9sf4_15
cgttgttcagggatctgccg

SEQ ID NO: 60815 - DNA, 20 bp, Artificial Sequence
  sgRNA
  Tm9sf4_16
ggtgtagccaaagtagagga

SEQ ID NO: 60816 - DNA, 20 bp, Artificial Sequence
  sgRNA
  Tm9sf4_17
ataccgtgtcgtccgcttcg

SEQ ID NO: 60817 - DNA, 20 bp, Artificial Sequence
  sgRNA
  Tm9sf4_18
aattgattggcgcgactcca

SEQ ID NO: 60818 - DNA, 20 bp, Artificial Sequence
  sgRNA
  Tm9sf4_19
taggtaagtgtcccatcgag

SEQ ID NO: 60819 - DNA, 20 bp, Artificial Sequence
  sgRNA
  Tm9sf4_20
tatcttgcggacaaacatgt

SEQ ID NO: 60820 - DNA, 20 bp, Artificial Sequence
  sgRNA
  Tmc7_1
attacctaagaatcgtcagg

SEQ ID NO: 60821 - DNA, 20 bp, Artificial Sequence
  sgRNA
  Tmc7_2
gctatcggtcagtggcacgt

SEQ ID NO: 60822 - DNA, 20 bp, Artificial Sequence
  sgRNA
  Tmc7_3
gtgcttatcaagtaagccag

SEQ ID NO: 60823 - DNA, 20 bp, Artificial Sequence
  sgRNA
  Tmc7_4
tttcaggaaagtttggcacg

SEQ ID NO: 60824 - DNA, 20 bp, Artificial Sequence
  sgRNA
  Tmc7_5
gccagggtaatcacaatgga

SEQ ID NO: 60825 - DNA, 20 bp, Artificial Sequence
  sgRNA
  Tmc7_6
acacctgcagaccctccccg

SEQ ID NO: 60826 - DNA, 20 bp, Artificial Sequence
  sgRNA
  Tmc7_7
tggggtaatgaaattggcca

SEQ ID NO: 60827 - DNA, 20 bp, Artificial Sequence
  sgRNA
  Tmc7_8
gtagtgcccataaaaaaggc

SEQ ID NO: 60828 - DNA, 20 bp, Artificial Sequence
  sgRNA
  Tmc7_9
gggtaatcacaatggacggg

SEQ ID NO: 60829 - DNA, 20 bp, Artificial Sequence
  sgRNA
  Tmc7_10
cgttacatcagaagccttcg

SEQ ID NO: 60830 - DNA, 20 bp, Artificial Sequence
  sgRNA
  Tmc7_11
catacctctgaccatcagca

SEQ ID NO: 60831 - DNA, 20 bp, Artificial Sequence
  sgRNA
  Tmc7_12
agatgatcaggaatatcacc

SEQ ID NO: 60832 - DNA, 20 bp, Artificial Sequence
  sgRNA
  Tmc7_13
gccatccccgacaatgtcct

SEQ ID NO: 60833 - DNA, 20 bp, Artificial Sequence
  sgRNA
  Tmc7_14
gatcaacctgattcggagcg

SEQ ID NO: 60834 - DNA, 20 bp, Artificial Sequence
  sgRNA
  Tmc7_15
tcaccaggttcagcaccacc

SEQ ID NO: 60835 - DNA, 20 bp, Artificial Sequence
  sgRNA
  Tmc7_16
gttcagtgcatacttgcgga

SEQ ID NO: 60836 - DNA, 20 bp, Artificial Sequence
  sgRNA
  Tmc7_17
cgtgcttatcaagtaagcca

SEQ ID NO: 60837 - DNA, 20 bp, Artificial Sequence
  sgRNA
  Tmc7_18
cgtgccactgaccgatagct

SEQ ID NO: 60838 - DNA, 20 bp, Artificial Sequence
  sgRNA
  Tmc7_19
aggcttctgatgtaacggca

SEQ ID NO: 60839 - DNA, 20 bp, Artificial Sequence
  sgRNA
  Tmc7_20
gcttcagctcagccatgctg

SEQ ID NO: 60840 - DNA, 20 bp, Artificial Sequence
  sgRNA
  Tmco3_1
gcagaatatgacgaagcggg

SEQ ID NO: 60841 - DNA, 20 bp, Artificial Sequence
  sgRNA
  Tmco3_2
catgccatcaagctgcaccg

SEQ ID NO: 60842 - DNA, 20 bp, Artificial Sequence
  sgRNA
  Tmco3_3
ttcctagtgggaagtgcccg

SEQ ID NO: 60843 - DNA, 20 bp, Artificial Sequence
  sgRNA
  Tmco3_4
gtgtggaggatatccttaca

SEQ ID NO: 60844 - DNA, 20 bp, Artificial Sequence
  sgRNA
  Tmco3_5
tcaagtggatcgtatccgct

SEQ ID NO: 60845 - DNA, 20 bp, Artificial Sequence
  sgRNA
  Tmco3_6
actaggaacctggataccag

SEQ ID NO: 60846 - DNA, 20 bp, Artificial Sequence
  sgRNA
  Tmco3_7
ggtgttcctcaccctgtccg

SEQ ID NO: 60847 - DNA, 20 bp, Artificial Sequence
  sgRNA
  Tmco3_8
tgaagtggtggtctgcgcgt

SEQ ID NO: 60848 - DNA, 20 bp, Artificial Sequence
  sgRNA
  Tmco3_9
tcttgtctctcatcctgccg

SEQ ID NO: 60849 - DNA, 20 bp, Artificial Sequence
  sgRNA
  Tmco3_10
gaagaatgccatcagagccg

SEQ ID NO: 60850 - DNA, 20 bp, Artificial Sequence
  sgRNA
  Tmco3_11
gatctcctcctccagacggt

SEQ ID NO: 60851 - DNA, 20 bp, Artificial Sequence
  sgRNA
  Tmco3_12
atcagcagcgtcatatagca

SEQ ID NO: 60852 - DNA, 20 bp, Artificial Sequence
  sgRNA
  Tmco3_13
cgtcaactcatagatcacaa

SEQ ID NO: 60853 - DNA, 20 bp, Artificial Sequence
  sgRNA
  Tmco3_14
gtattatcgaaagctgcacc

SEQ ID NO: 60854 - DNA, 20 bp, Artificial Sequence
  sgRNA
  Tmco3_15
ggaaatgaagacactctgag

SEQ ID NO: 60855 - DNA, 20 bp, Artificial Sequence
  sgRNA
  Tmco3_16
ccaagggcacatggtcaccg

SEQ ID NO: 60856 - DNA, 20 bp, Artificial Sequence
  sgRNA
  Tmco3_17
cctggtatccaggttcctag

SEQ ID NO: 60857 - DNA, 20 bp, Artificial Sequence
  sgRNA
  Tmco3_18
tgccgcagaaaaacaccaag

SEQ ID NO: 60858 - DNA, 20 bp, Artificial Sequence
  sgRNA
  Tmco3_19
gagtgggtctgatccgcagg

SEQ ID NO: 60859 - DNA, 20 bp, Artificial Sequence
  sgRNA
  Tmco3_20
cctcgatctcctcctccaga

SEQ ID NO: 60860 - DNA, 20 bp, Artificial Sequence
  sgRNA
  Tmed7_1
tgatggtaaagtgttgtaca

SEQ ID NO: 60861 - DNA, 20 bp, Artificial Sequence
  sgRNA
  Tmed7_2
cttgtacgtcccatttctgg

SEQ ID NO: 60862 - DNA, 20 bp, Artificial Sequence
  sgRNA
  Tmed7_3
ttctacgaggacatcactca

SEQ ID NO: 60863 - DNA, 20 bp, Artificial Sequence
  sgRNA
  Tmed7_4
ggcattatcgggcagctcga

SEQ ID NO: 60864 - DNA, 20 bp, Artificial Sequence
  sgRNA
  Tmed7_5
gccctacgctaaccaccaga

SEQ ID NO: 60865 - DNA, 20 bp, Artificial Sequence
  sgRNA
  Tmed7_6
gtgatctcggagccgccgct

SEQ ID NO: 60866 - DNA, 20 bp, Artificial Sequence
  sgRNA
  Tmed7_7
tgtcgattggaagatcctga

SEQ ID NO: 60867 - DNA, 20 bp, Artificial Sequence
  sgRNA
  Tmed7_8
agtggcctattggtcggtgg

SEQ ID NO: 60868 - DNA, 20 bp, Artificial Sequence
  sgRNA
  Tmed7_9
ctacgatgttgattgtcgat

SEQ ID NO: 60869 - DNA, 20 bp, Artificial Sequence
  sgRNA
  Tmed7_10
tcaaggccgaagccgagcag

SEQ ID NO: 60870 - DNA, 20 bp, Artificial Sequence
  sgRNA
  Tmed7_11
agaggatctgaatacaagag

SEQ ID NO: 60871 - DNA, 20 bp, Artificial Sequence
  sgRNA
  Tmed7_12
tgccaagcagtgcttctacg

SEQ ID NO: 60872 - DNA, 20 bp, Artificial Sequence
  sgRNA
  Tmed7_13
gtgtatttcgatttccaagt

SEQ ID NO: 60873 - DNA, 20 bp, Artificial Sequence
  sgRNA
  Tmed7_14
gcactgactcggttctcact

SEQ ID NO: 60874 - DNA, 20 bp, Artificial Sequence
  sgRNA
  Tmed7_15
tccttctggtggttagcgta

SEQ ID NO: 60875 - DNA, 20 bp, Artificial Sequence
  sgRNA
  Tmed7_16
ttgtattcagatcctctgct

SEQ ID NO: 60876 - DNA, 20 bp, Artificial Sequence
  sgRNA
  Tmed7_17
agaaccaccacaacccgcgt

SEQ ID NO: 60877 - DNA, 20 bp, Artificial Sequence
  sgRNA
  Tmed7_18
caagcagcctgcaaccccaa

SEQ ID NO: 60878 - DNA, 20 bp, Artificial Sequence
  sgRNA
  Tmed7_19
gctaaccaccagaaggatga

SEQ ID NO: 60879 - DNA, 20 bp, Artificial Sequence
  sgRNA
  Tmed7_20
gggcagctcgaaggtgatct

SEQ ID NO: 60880 - DNA, 20 bp, Artificial Sequence
  sgRNA
  Tmeff1_1
gcaccagaaagacataaccg

SEQ ID NO: 60881 - DNA, 20 bp, Artificial Sequence
  sgRNA
  Tmeff1_2
attgttataggaactcccgt

SEQ ID NO: 60882 - DNA, 20 bp, Artificial Sequence
  sgRNA
  Tmeff1_3
ccctgtctgtgggtcaaacg

SEQ ID NO: 60883 - DNA, 20 bp, Artificial Sequence
  sgRNA
  Tmeff1_4
cgccgtctgcggctacacgt

SEQ ID NO: 60884 - DNA, 20 bp, Artificial Sequence
  sgRNA
  Tmeff1_5
gtacaaggccgagtgtgacg

SEQ ID NO: 60885 - DNA, 20 bp, Artificial Sequence
  sgRNA
  Tmeff1_6
gacgcttctcggacgaaaca

SEQ ID NO: 60886 - DNA, 20 bp, Artificial Sequence
  sgRNA
  Tmeff1_7
gcaaggtccacgcgccacca

SEQ ID NO: 60887 - DNA, 20 bp, Artificial Sequence
  sgRNA
  Tmeff1_8
gagaaagcactcattctggt

SEQ ID NO: 60888 - DNA, 20 bp, Artificial Sequence
  sgRNA
  Tmeff1_9
tcaatgggtactgcatccat

SEQ ID NO: 60889 - DNA, 20 bp, Artificial Sequence
  sgRNA
  Tmeff1_10
ccaagaacaatagagggcgg

SEQ ID NO: 60890 - DNA, 20 bp, Artificial Sequence
  sgRNA
  Tmeff1_11
accctgtgtgcgcttccgac

SEQ ID NO: 60891 - DNA, 20 bp, Artificial Sequence
  sgRNA
  Tmeff1_12
aatgccccaagaacaataga

SEQ ID NO: 60892 - DNA, 20 bp, Artificial Sequence
  sgRNA
  Tmeff1_13
cttgccctgaaaacctcaat

SEQ ID NO: 60893 - DNA, 20 bp, Artificial Sequence
  sgRNA
  Tmeff1_14
ccagaaagacataaccgtgg

SEQ ID NO: 60894 - DNA, 20 bp, Artificial Sequence
  sgRNA
  Tmeff1_15
aaccctgtgtgcgcttccga

SEQ ID NO: 60895 - DNA, 20 bp, Artificial Sequence
  sgRNA
  Tmeff1_16
tgctcagttgtcttgccgaa

SEQ ID NO: 60896 - DNA, 20 bp, Artificial Sequence
  sgRNA
  Tmeff1_17
gccccaagaacaatagaggg

SEQ ID NO: 60897 - DNA, 20 bp, Artificial Sequence
  sgRNA
  Tmeff1_18
ttattgggaaagaaggacga

SEQ ID NO: 60898 - DNA, 20 bp, Artificial Sequence
  sgRNA
  Tmeff1_19
gtacttgcacggtccacact

SEQ ID NO: 60899 - DNA, 20 bp, Artificial Sequence
  sgRNA
  Tmeff1_20
gtgtggaccgtgcaagtaca

SEQ ID NO: 60900 - DNA, 20 bp, Artificial Sequence
  sgRNA
  Tmeff2_1
caacacctgtaaatttgacg

SEQ ID NO: 60901 - DNA, 20 bp, Artificial Sequence
  sgRNA
  Tmeff2_2
gctgcttatcatagcccgcc

SEQ ID NO: 60902 - DNA, 20 bp, Artificial Sequence
  sgRNA
  Tmeff2_3
acagcagagtgagatacttg

SEQ ID NO: 60903 - DNA, 20 bp, Artificial Sequence
  sgRNA
  Tmeff2_4
caaccactaaatctgaagat

SEQ ID NO: 60904 - DNA, 20 bp, Artificial Sequence
  sgRNA
  Tmeff2_5
acacaacaagagcatccaca

SEQ ID NO: 60905 - DNA, 20 bp, Artificial Sequence
  sgRNA
  Tmeff2_6
tcagattgctgtcatctgcg

SEQ ID NO: 60906 - DNA, 20 bp, Artificial Sequence
  sgRNA
  Tmeff2_7
gctatgataagcagcgtcac

SEQ ID NO: 60907 - DNA, 20 bp, Artificial Sequence
  sgRNA
  Tmeff2_8
atcccctctgtgcttctgat

SEQ ID NO: 60908 - DNA, 20 bp, Artificial Sequence
  sgRNA
  Tmeff2_9
tttagaagagaccaactcaa

SEQ ID NO: 60909 - DNA, 20 bp, Artificial Sequence
  sgRNA
  Tmeff2_10
ccttgcccagaacattataa

SEQ ID NO: 60910 - DNA, 20 bp, Artificial Sequence
  sgRNA
  Tmeff2_11
tctaaagatgatgcagtaca

SEQ ID NO: 60911 - DNA, 20 bp, Artificial Sequence
  sgRNA
  Tmeff2_12
cgtttggcagtcacttaagg

SEQ ID NO: 60912 - DNA, 20 bp, Artificial Sequence
  sgRNA
  Tmeff2_13
tctccattggagccacacac

SEQ ID NO: 60913 - DNA, 20 bp, Artificial Sequence
  sgRNA
  Tmeff2_14
agtgactgccaaacgcccac

SEQ ID NO: 60914 - DNA, 20 bp, Artificial Sequence
  sgRNA
  Tmeff2_15
atgcccatcttcagatttag

SEQ ID NO: 60915 - DNA, 20 bp, Artificial Sequence
  sgRNA
  Tmeff2_16
gtccagctgctgcactgccg

SEQ ID NO: 60916 - DNA, 20 bp, Artificial Sequence
  sgRNA
  Tmeff2_17
ccaacacctgtaaatttgac

SEQ ID NO: 60917 - DNA, 20 bp, Artificial Sequence
  sgRNA
  Tmeff2_18
agatggctcctgcatattga

SEQ ID NO: 60918 - DNA, 20 bp, Artificial Sequence
  sgRNA
  Tmeff2_19
agacaaagagaagctgccaa

SEQ ID NO: 60919 - DNA, 20 bp, Artificial Sequence
  sgRNA
  Tmeff2_20
tttcccatcagaagcacaga

SEQ ID NO: 60920 - DNA, 20 bp, Artificial Sequence
  sgRNA
  Tmem104_1
tggaaatgactcttgcggcg

SEQ ID NO: 60921 - DNA, 20 bp, Artificial Sequence
  sgRNA
  Tmem104_2
tggtattcgtaggcttcatg

SEQ ID NO: 60922 - DNA, 20 bp, Artificial Sequence
  sgRNA
  Tmem104_3
tcagccaagacaactacgag

SEQ ID NO: 60923 - DNA, 20 bp, Artificial Sequence
  sgRNA
  Tmem104_4
acccccaagaagttggctag

SEQ ID NO: 60924 - DNA, 20 bp, Artificial Sequence
  sgRNA
  Tmem104_5
tgtacaccctcaacttcgcg

SEQ ID NO: 60925 - DNA, 20 bp, Artificial Sequence
  sgRNA
  Tmem104_6
cctccaagcgccacatcacg

SEQ ID NO: 60926 - DNA, 20 bp, Artificial Sequence
  sgRNA
  Tmem104_7
gtagacatccacccggcgca

SEQ ID NO: 60927 - DNA, 20 bp, Artificial Sequence
  sgRNA
  Tmem104_8
ctacgaataccagcagaacg

SEQ ID NO: 60928 - DNA, 20 bp, Artificial Sequence
  sgRNA
  Tmem104_9
tggagacctcgccatctacg

SEQ ID NO: 60929 - DNA, 20 bp, Artificial Sequence
  sgRNA
  Tmem104_10
ccactcggtctaccacccat

SEQ ID NO: 60930 - DNA, 20 bp, Artificial Sequence
  sgRNA
  Tmem104_11
tgtgacaaccacctttgcga

SEQ ID NO: 60931 - DNA, 20 bp, Artificial Sequence
  sgRNA
  Tmem104_12
aggcctttgccaccgccggg

SEQ ID NO: 60932 - DNA, 20 bp, Artificial Sequence
  sgRNA
  Tmem104_13
aacgaggctgacgagccacc

SEQ ID NO: 60933 - DNA, 20 bp, Artificial Sequence
  sgRNA
  Tmem104_14
cgtcttccagttgttgcgca

SEQ ID NO: 60934 - DNA, 20 bp, Artificial Sequence
  sgRNA
  Tmem104_15
gttccgccacaccttctggg

SEQ ID NO: 60935 - DNA, 20 bp, Artificial Sequence
  sgRNA
  Tmem104_16
agattcggtagacatccacc

SEQ ID NO: 60936 - DNA, 20 bp, Artificial Sequence
  sgRNA
  Tmem104_17
cctggtgtacctctgccgca

SEQ ID NO: 60937 - DNA, 20 bp, Artificial Sequence
  sgRNA
  Tmem104_18
cagccaagacaactacgaga

SEQ ID NO: 60938 - DNA, 20 bp, Artificial Sequence
  sgRNA
  Tmem104_19
tgtccatgaggctgtcccca

SEQ ID NO: 60939 - DNA, 20 bp, Artificial Sequence
  sgRNA
  Tmem104_20
cccatgggtggtagaccgag

SEQ ID NO: 60940 - DNA, 20 bp, Artificial Sequence
  sgRNA
  Tmem106a_1
tcacgtacagctcaacacga

SEQ ID NO: 60941 - DNA, 20 bp, Artificial Sequence
  sgRNA
  Tmem106a_2
tcatcccttatggagaccaa

SEQ ID NO: 60942 - DNA, 20 bp, Artificial Sequence
  sgRNA
  Tmem106a_3
tcctacctgccaaggcaatg

SEQ ID NO: 60943 - DNA, 20 bp, Artificial Sequence
  sgRNA
  Tmem106a_4
gctgggttatcaggtaggat

SEQ ID NO: 60944 - DNA, 20 bp, Artificial Sequence
  sgRNA
  Tmem106a_5
ggacgcacagcaatgggccg

SEQ ID NO: 60945 - DNA, 20 bp, Artificial Sequence
  sgRNA
  Tmem106a_6
acatattcaaagctctcgaa

SEQ ID NO: 60946 - DNA, 20 bp, Artificial Sequence
  sgRNA
  Tmem106a_7
gctgccaactacttcagcac

SEQ ID NO: 60947 - DNA, 20 bp, Artificial Sequence
  sgRNA
  Tmem106a_8
gctaccagtgctgaagtagt

SEQ ID NO: 60948 - DNA, 20 bp, Artificial Sequence
  sgRNA
  Tmem106a_9
gcaggcagatggccaccgac

SEQ ID NO: 60949 - DNA, 20 bp, Artificial Sequence
  sgRNA
  Tmem106a_10
agtgacacagctgacggccg

SEQ ID NO: 60950 - DNA, 20 bp, Artificial Sequence
  sgRNA
  Tmem106a_11
tgccttacgaagttgccagc

SEQ ID NO: 60951 - DNA, 20 bp, Artificial Sequence
  sgRNA
  Tmem106a_12
ccggggatacaggaaaaaga

SEQ ID NO: 60952 - DNA, 20 bp, Artificial Sequence
  sgRNA
  Tmem106a_13
agaggcctggtggagcacct

SEQ ID NO: 60953 - DNA, 20 bp, Artificial Sequence
  sgRNA
  Tmem106a_14
tgtcctacctgccaaggcaa

SEQ ID NO: 60954 - DNA, 20 bp, Artificial Sequence
  sgRNA
  Tmem106a_15
catcacagtgacacagctga

SEQ ID NO: 60955 - DNA, 20 bp, Artificial Sequence
  sgRNA
  Tmem106a_16
cctacctgataacccagcca

SEQ ID NO: 60956 - DNA, 20 bp, Artificial Sequence
  sgRNA
  Tmem106a_17
cttgtcctcatccttccgag

SEQ ID NO: 60957 - DNA, 20 bp, Artificial Sequence
  sgRNA
  Tmem106a_18
gtggaagagttgaggccgac

SEQ ID NO: 60958 - DNA, 20 bp, Artificial Sequence
  sgRNA
  Tmem106a_19
gctctttgtgttcctgtcgg

SEQ ID NO: 60959 - DNA, 20 bp, Artificial Sequence
  sgRNA
  Tmem106a_20
ggatattcaaaagaatatgg

SEQ ID NO: 60960 - DNA, 20 bp, Artificial Sequence
  sgRNA
  Tmem106b_1
ttcagcgtcgtagctgacat

SEQ ID NO: 60961 - DNA, 20 bp, Artificial Sequence
  sgRNA
  Tmem106b_2
aaaacacagccaatccagac

SEQ ID NO: 60962 - DNA, 20 bp, Artificial Sequence
  sgRNA
  Tmem106b_3
agtgaagtgcacaacgaaga

SEQ ID NO: 60963 - DNA, 20 bp, Artificial Sequence
  sgRNA
  Tmem106b_4
ttcaaaaaccgtgattggaa

SEQ ID NO: 60964 - DNA, 20 bp, Artificial Sequence
  sgRNA
  Tmem106b_5
acttcacctcaatagatcga

SEQ ID NO: 60965 - DNA, 20 bp, Artificial Sequence
  sgRNA
  Tmem106b_6
aaggaacacgacttaccagt

SEQ ID NO: 60966 - DNA, 20 bp, Artificial Sequence
  sgRNA
  Tmem106b_7
atggaatcaatgccaccagt

SEQ ID NO: 60967 - DNA, 20 bp, Artificial Sequence
  sgRNA
  Tmem106b_8
catttcctctgcaataactg

SEQ ID NO: 60968 - DNA, 20 bp, Artificial Sequence
  sgRNA
  Tmem106b_9
ggtacccacagttattgcag

SEQ ID NO: 60969 - DNA, 20 bp, Artificial Sequence
  sgRNA
  Tmem106b_10
ttaaacaacataactaacat

SEQ ID NO: 60970 - DNA, 20 bp, Artificial Sequence
  sgRNA
  Tmem106b_11
tgattccatatagtgatcag

SEQ ID NO: 60971 - DNA, 20 bp, Artificial Sequence
  sgRNA
  Tmem106b_12
ggaacaggaagaattcctag

SEQ ID NO: 60972 - DNA, 20 bp, Artificial Sequence
  sgRNA
  Tmem106b_13
ggacatttagatactcagac

SEQ ID NO: 60973 - DNA, 20 bp, Artificial Sequence
  sgRNA
  Tmem106b_14
atttcctctgcaataactgt

SEQ ID NO: 60974 - DNA, 20 bp, Artificial Sequence
  sgRNA
  Tmem106b_15
tacttcacctcaatagatcg

SEQ ID NO: 60975 - DNA, 20 bp, Artificial Sequence
  sgRNA
  Tmem106b_16
tcttctttatttgaatgcaa

SEQ ID NO: 60976 - DNA, 20 bp, Artificial Sequence
  sgRNA
  Tmem106b_17
gatactcagactgggccaac

SEQ ID NO: 60977 - DNA, 20 bp, Artificial Sequence
  sgRNA
  Tmem106b_18
tcgacagacaatatgagaaa

SEQ ID NO: 60978 - DNA, 20 bp, Artificial Sequence
  sgRNA
  Tmem106b_19
accagtatgtcgactgtgga

SEQ ID NO: 60979 - DNA, 20 bp, Artificial Sequence
  sgRNA
  Tmem106b_20
ctgagcagatatctcaggaa

SEQ ID NO: 60980 - DNA, 20 bp, Artificial Sequence
  sgRNA
  Tmem108_1
gaagagaagtagcccccgag

SEQ ID NO: 60981 - DNA, 20 bp, Artificial Sequence
  sgRNA
  Tmem108_2
actctcacacccgtaccggg

SEQ ID NO: 60982 - DNA, 20 bp, Artificial Sequence
  sgRNA
  Tmem108_3
ggctttatcagatccaacca

SEQ ID NO: 60983 - DNA, 20 bp, Artificial Sequence
  sgRNA
  Tmem108_4
agggtctgtagagattccct

SEQ ID NO: 60984 - DNA, 20 bp, Artificial Sequence
  sgRNA
  Tmem108_5
ctacttcaacagacacgcgg

SEQ ID NO: 60985 - DNA, 20 bp, Artificial Sequence
  sgRNA
  Tmem108_6
tggtccctgagggatgcccg

SEQ ID NO: 60986 - DNA, 20 bp, Artificial Sequence
  sgRNA
  Tmem108_7
acacgcggtggagctcccga

SEQ ID NO: 60987 - DNA, 20 bp, Artificial Sequence
  sgRNA
  Tmem108_8
gggtcttcacggctgccaca

SEQ ID NO: 60988 - DNA, 20 bp, Artificial Sequence
  sgRNA
  Tmem108_9
ggactacttcaacagacacg

SEQ ID NO: 60989 - DNA, 20 bp, Artificial Sequence
  sgRNA
  Tmem108_10
tgtggccaacatctcccacg

SEQ ID NO: 60990 - DNA, 20 bp, Artificial Sequence
  sgRNA
  Tmem108_11
cctggcagaaggggttcacg

SEQ ID NO: 60991 - DNA, 20 bp, Artificial Sequence
  sgRNA
  Tmem108_12
atttggaagatcttccccag

SEQ ID NO: 60992 - DNA, 20 bp, Artificial Sequence
  sgRNA
  Tmem108_13
gcggttgaggaagttgcccg

SEQ ID NO: 60993 - DNA, 20 bp, Artificial Sequence
  sgRNA
  Tmem108_14
cctcccccacgacaaccgac

SEQ ID NO: 60994 - DNA, 20 bp, Artificial Sequence
  sgRNA
  Tmem108_15
gctttatcagatccaaccag

SEQ ID NO: 60995 - DNA, 20 bp, Artificial Sequence
  sgRNA
  Tmem108_16
ggtaccagggaagttgtggg

SEQ ID NO: 60996 - DNA, 20 bp, Artificial Sequence
  sgRNA
  Tmem108_17
agtgtctcgatagtcgccat

SEQ ID NO: 60997 - DNA, 20 bp, Artificial Sequence
  sgRNA
  Tmem108_18
tgtccacgaaccatctccca

SEQ ID NO: 60998 - DNA, 20 bp, Artificial Sequence
  sgRNA
  Tmem108_19
accctgccaacaaagccagc

SEQ ID NO: 60999 - DNA, 20 bp, Artificial Sequence
  sgRNA
  Tmem108_20
gtagacgtggtgtctgtagg

SEQ ID NO: 61000 - DNA, 20 bp, Artificial Sequence
  sgRNA
  Tmem114_1
ggtacatcatcgacaccgag

SEQ ID NO: 61001 - DNA, 20 bp, Artificial Sequence
  sgRNA
  Tmem114_2
gccactcagtctgatcgtga

SEQ ID NO: 61002 - DNA, 20 bp, Artificial Sequence
  sgRNA
  Tmem114_3
aagttctccagagtcccgag

SEQ ID NO: 61003 - DNA, 20 bp, Artificial Sequence
  sgRNA
  Tmem114_4
gttgatgaaccctttctggc

SEQ ID NO: 61004 - DNA, 20 bp, Artificial Sequence
  sgRNA
  Tmem114_5
gatcaggtggatatacgctt

SEQ ID NO: 61005 - DNA, 20 bp, Artificial Sequence
  sgRNA
  Tmem114_6
tatatccacctgatccagca

SEQ ID NO: 61006 - DNA, 20 bp, Artificial Sequence
  sgRNA
  Tmem114_7
gcagggccctctcctccagg

SEQ ID NO: 61007 - DNA, 20 bp, Artificial Sequence
  sgRNA
  Tmem114_8
atacaaagctaatccagccg

SEQ ID NO: 61008 - DNA, 20 bp, Artificial Sequence
  sgRNA
  Tmem114_9
tacaaagctaatccagccga

SEQ ID NO: 61009 - DNA, 20 bp, Artificial Sequence
  sgRNA
  Tmem114_10
ccaggaggcatactgcctct

SEQ ID NO: 61010 - DNA, 20 bp, Artificial Sequence
  sgRNA
  Tmem114_11
ctcagcagttgccttccgag

SEQ ID NO: 61011 - DNA, 20 bp, Artificial Sequence
  sgRNA
  Tmem114_12
gtagatgctgattccagtga

SEQ ID NO: 61012 - DNA, 20 bp, Artificial Sequence
  sgRNA
  Tmem114_13
gctcagcctgagccagaggc

SEQ ID NO: 61013 - DNA, 20 bp, Artificial Sequence
  sgRNA
  Tmem114_14
gtatatccacctgatccagc

SEQ ID NO: 61014 - DNA, 20 bp, Artificial Sequence
  sgRNA
  Tmem114_15
agttctccagagtcccgagt

SEQ ID NO: 61015 - DNA, 20 bp, Artificial Sequence
  sgRNA
  Tmem114_16
tgtatctgagctgctcactg

SEQ ID NO: 61016 - DNA, 20 bp, Artificial Sequence
  sgRNA
  Tmem114_17
agagcctctgagctcccact

SEQ ID NO: 61017 - DNA, 20 bp, Artificial Sequence
  sgRNA
  Tmem114_18
gggactctggagaacttgcc

SEQ ID NO: 61018 - DNA, 20 bp, Artificial Sequence
  sgRNA
  Tmem114_19
gctgctcctttccagcctct

SEQ ID NO: 61019 - DNA, 20 bp, Artificial Sequence
  sgRNA
  Tmem114_20
gattccagtgagggtcacca

SEQ ID NO: 61020 - DNA, 20 bp, Artificial Sequence
  sgRNA
  Tmem116_1
ggtacattaccatgatggtg

SEQ ID NO: 61021 - DNA, 20 bp, Artificial Sequence
  sgRNA
  Tmem116_2
tgagtgcattaggatacacc

SEQ ID NO: 61022 - DNA, 20 bp, Artificial Sequence
  sgRNA
  Tmem116_3
gctgcagacagatgtattgg

SEQ ID NO: 61023 - DNA, 20 bp, Artificial Sequence
  sgRNA
  Tmem116_4
tggaccccagcagcacacaa

SEQ ID NO: 61024 - DNA, 20 bp, Artificial Sequence
  sgRNA
  Tmem116_5
gcgagtgcgtttcttcccag

SEQ ID NO: 61025 - DNA, 20 bp, Artificial Sequence
  sgRNA
  Tmem116_6
ttacgagccagcaaattccc

SEQ ID NO: 61026 - DNA, 20 bp, Artificial Sequence
  sgRNA
  Tmem116_7
gcacttggcgacactcggct

SEQ ID NO: 61027 - DNA, 20 bp, Artificial Sequence
  sgRNA
  Tmem116_8
cgttgccctctctctcgcct

SEQ ID NO: 61028 - DNA, 20 bp, Artificial Sequence
  sgRNA
  Tmem116_9
gctataacctacagaccgtg

SEQ ID NO: 61029 - DNA, 20 bp, Artificial Sequence
  sgRNA
  Tmem116_10
tcttatataacatctgggca

SEQ ID NO: 61030 - DNA, 20 bp, Artificial Sequence
  sgRNA
  Tmem116_11
aggcaagcagagcaagtggt

SEQ ID NO: 61031 - DNA, 20 bp, Artificial Sequence
  sgRNA
  Tmem116_12
aacacaggcgtcatcagcag

SEQ ID NO: 61032 - DNA, 20 bp, Artificial Sequence
  sgRNA
  Tmem116_13
gggcaagaggagactccagt

SEQ ID NO: 61033 - DNA, 20 bp, Artificial Sequence
  sgRNA
  Tmem116_14
cagacaccagatgtagctga

SEQ ID NO: 61034 - DNA, 20 bp, Artificial Sequence
  sgRNA
  Tmem116_15
tgtcagcttcatgatcagca

SEQ ID NO: 61035 - DNA, 20 bp, Artificial Sequence
  sgRNA
  Tmem116_16
gctcccatctgccttccagg

SEQ ID NO: 61036 - DNA, 20 bp, Artificial Sequence
  sgRNA
  Tmem116_17
ctctcacagcagcatcccag

SEQ ID NO: 61037 - DNA, 20 bp, Artificial Sequence
  sgRNA
  Tmem116_18
tctcgcctcggaagaagacg

SEQ ID NO: 61038 - DNA, 20 bp, Artificial Sequence
  sgRNA
  Tmem116_19
agcagcacacaaaggccact

SEQ ID NO: 61039 - DNA, 20 bp, Artificial Sequence
  sgRNA
  Tmem116_20
cccactggagaccagccgcc

SEQ ID NO: 61040 - DNA, 20 bp, Artificial Sequence
  sgRNA
  Tmem123_1
gaggcagtaggcgtcacatg

SEQ ID NO: 61041 - DNA, 20 bp, Artificial Sequence
  sgRNA
  Tmem123_2
caggacccgaccgacgctca

SEQ ID NO: 61042 - DNA, 20 bp, Artificial Sequence
  sgRNA
  Tmem123_3
caataaactactgtgggctg

SEQ ID NO: 61043 - DNA, 20 bp, Artificial Sequence
  sgRNA
  Tmem123_4
taccaaccagaccatgagtg

SEQ ID NO: 61044 - DNA, 20 bp, Artificial Sequence
  sgRNA
  Tmem123_5
gcaactactcatcccaccaa

SEQ ID NO: 61045 - DNA, 20 bp, Artificial Sequence
  sgRNA
  Tmem123_6
accatgacgtctggaagccg

SEQ ID NO: 61046 - DNA, 20 bp, Artificial Sequence
  sgRNA
  Tmem123_7
tataccaccaacaaagctgc

SEQ ID NO: 61047 - DNA, 20 bp, Artificial Sequence
  sgRNA
  Tmem123_8
actcatcccaccaaaggcaa

SEQ ID NO: 61048 - DNA, 20 bp, Artificial Sequence
  sgRNA
  Tmem123_9
gcaggtgctggcgctgctag

SEQ ID NO: 61049 - DNA, 20 bp, Artificial Sequence
  sgRNA
  Tmem123_10
attgttaaaatatcaacccc

SEQ ID NO: 61050 - DNA, 20 bp, Artificial Sequence
  sgRNA
  Tmem123_11
gatgccggcagctttgttgg

SEQ ID NO: 61051 - DNA, 20 bp, Artificial Sequence
  sgRNA
  Tmem123_12
tgctgctgcttcgtgtaaca

SEQ ID NO: 61052 - DNA, 20 bp, Artificial Sequence
  sgRNA
  Tmem123_13
agttgtcaataaactactgt

SEQ ID NO: 61053 - DNA, 20 bp, Artificial Sequence
  sgRNA
  Tmem123_14
tattggaggtcagcactgag

SEQ ID NO: 61054 - DNA, 20 bp, Artificial Sequence
  sgRNA
  Tmem123_15
tcacatgtggtaagactcct

SEQ ID NO: 61055 - DNA, 20 bp, Artificial Sequence
  sgRNA
  Tmem123_16
aggtttcacagtgataagtg

SEQ ID NO: 61056 - DNA, 20 bp, Artificial Sequence
  sgRNA
  Tmem123_17
gctgacgtgtgggtagagtt

SEQ ID NO: 61057 - DNA, 20 bp, Artificial Sequence
  sgRNA
  Tmem123_18
tgtcatggatgctgacgtgt

SEQ ID NO: 61058 - DNA, 20 bp, Artificial Sequence
  sgRNA
  Tmem123_19
tggcagtacggaaggcttcg

SEQ ID NO: 61059 - DNA, 20 bp, Artificial Sequence
  sgRNA
  Tmem123_20
ttggatcctttgcctttggt

SEQ ID NO: 61060 - DNA, 20 bp, Artificial Sequence
  sgRNA
  Tmem132a_1
agccgcaccggaatacgctg

SEQ ID NO: 61061 - DNA, 20 bp, Artificial Sequence
  sgRNA
  Tmem132a_2
ggtctaacttagcagtccag

SEQ ID NO: 61062 - DNA, 20 bp, Artificial Sequence
  sgRNA
  Tmem132a_3
tatgcgaggatcttgcacat

SEQ ID NO: 61063 - DNA, 20 bp, Artificial Sequence
  sgRNA
  Tmem132a_4
accactctggaacaaatccg

SEQ ID NO: 61064 - DNA, 20 bp, Artificial Sequence
  sgRNA
  Tmem132a_5
gctaagttagaccgcttcaa

SEQ ID NO: 61065 - DNA, 20 bp, Artificial Sequence
  sgRNA
  Tmem132a_6
tcagtcagctcaatgcgcaa

SEQ ID NO: 61066 - DNA, 20 bp, Artificial Sequence
  sgRNA
  Tmem132a_7
tgagtggtgtgggtgccgaa

SEQ ID NO: 61067 - DNA, 20 bp, Artificial Sequence
  sgRNA
  Tmem132a_8
tctacgaccgcaatgacctg

SEQ ID NO: 61068 - DNA, 20 bp, Artificial Sequence
  sgRNA
  Tmem132a_9
gctttagtgaggcccgaagt

SEQ ID NO: 61069 - DNA, 20 bp, Artificial Sequence
  sgRNA
  Tmem132a_10
tttgcggctcacccgctgga

SEQ ID NO: 61070 - DNA, 20 bp, Artificial Sequence
  sgRNA
  Tmem132a_11
gcggtcgtagagctcggctg

SEQ ID NO: 61071 - DNA, 20 bp, Artificial Sequence
  sgRNA
  Tmem132a_12
taggtcggtgacacgctgag

SEQ ID NO: 61072 - DNA, 20 bp, Artificial Sequence
  sgRNA
  Tmem132a_13
aggcagaaccaggcaccgta

SEQ ID NO: 61073 - DNA, 20 bp, Artificial Sequence
  sgRNA
  Tmem132a_14
aggtgaggaggacatccgct

SEQ ID NO: 61074 - DNA, 20 bp, Artificial Sequence
  sgRNA
  Tmem132a_15
gtgtcaccgacctagagctg

SEQ ID NO: 61075 - DNA, 20 bp, Artificial Sequence
  sgRNA
  Tmem132a_16
gtggacccgaggaagagcat

SEQ ID NO: 61076 - DNA, 20 bp, Artificial Sequence
  sgRNA
  Tmem132a_17
gcatggtcagataccatagg

SEQ ID NO: 61077 - DNA, 20 bp, Artificial Sequence
  sgRNA
  Tmem132a_18
gctcccgtcccactaggatg

SEQ ID NO: 61078 - DNA, 20 bp, Artificial Sequence
  sgRNA
  Tmem132a_19
cagtcactcgccctgtcacg

SEQ ID NO: 61079 - DNA, 20 bp, Artificial Sequence
  sgRNA
  Tmem132a_20
gctcatgcagccctggccca

SEQ ID NO: 61080 - DNA, 20 bp, Artificial Sequence
  sgRNA
  Tmem132b_1
ggttcccgtcaaggtcgtgg

SEQ ID NO: 61081 - DNA, 20 bp, Artificial Sequence
  sgRNA
  Tmem132b_2
cacacggaagatcatcccca

SEQ ID NO: 61082 - DNA, 20 bp, Artificial Sequence
  sgRNA
  Tmem132b_3
ctgagtgaggacacgcacca

SEQ ID NO: 61083 - DNA, 20 bp, Artificial Sequence
  sgRNA
  Tmem132b_4
tgcactttatccagccaacg

SEQ ID NO: 61084 - DNA, 20 bp, Artificial Sequence
  sgRNA
  Tmem132b_5
agcaattccatagagcgcga

SEQ ID NO: 61085 - DNA, 20 bp, Artificial Sequence
  sgRNA
  Tmem132b_6
tggttgtgcactcctccgag

SEQ ID NO: 61086 - DNA, 20 bp, Artificial Sequence
  sgRNA
  Tmem132b_7
tggccaatcgtggttgccga

SEQ ID NO: 61087 - DNA, 20 bp, Artificial Sequence
  sgRNA
  Tmem132b_8
gtataggcacaaaaggttcg

SEQ ID NO: 61088 - DNA, 20 bp, Artificial Sequence
  sgRNA
  Tmem132b_9
aggtcatcgtgaggtcaccg

SEQ ID NO: 61089 - DNA, 20 bp, Artificial Sequence
  sgRNA
  Tmem132b_10
ttaccagaatccagtaaccc

SEQ ID NO: 61090 - DNA, 20 bp, Artificial Sequence
  sgRNA
  Tmem132b_11
tttgggccggaggaacccat

SEQ ID NO: 61091 - DNA, 20 bp, Artificial Sequence
  sgRNA
  Tmem132b_12
ggtgagccacgaggaccagt

SEQ ID NO: 61092 - DNA, 20 bp, Artificial Sequence
  sgRNA
  Tmem132b_13
gctgggatgaaaatgaccct

SEQ ID NO: 61093 - DNA, 20 bp, Artificial Sequence
  sgRNA
  Tmem132b_14
gccgtgttggaaccactcct

SEQ ID NO: 61094 - DNA, 20 bp, Artificial Sequence
  sgRNA
  Tmem132b_15
ctcctttcggaaatatggag

SEQ ID NO: 61095 - DNA, 20 bp, Artificial Sequence
  sgRNA
  Tmem132b_16
tcaatctgcaacggcaggcg

SEQ ID NO: 61096 - DNA, 20 bp, Artificial Sequence
  sgRNA
  Tmem132b_17
gcaaaggaaacgtcaaggtg

SEQ ID NO: 61097 - DNA, 20 bp, Artificial Sequence
  sgRNA
  Tmem132b_18
aacctctccatatttccgaa

SEQ ID NO: 61098 - DNA, 20 bp, Artificial Sequence
  sgRNA
  Tmem132b_19
cagcaattccatagagcgcg

SEQ ID NO: 61099 - DNA, 20 bp, Artificial Sequence
  sgRNA
  Tmem132b_20
tgaacaccgccattctcact

SEQ ID NO: 61100 - DNA, 20 bp, Artificial Sequence
  sgRNA
  Tmem132c_1
ttgggtgaggacgcgcactg

SEQ ID NO: 61101 - DNA, 20 bp, Artificial Sequence
  sgRNA
  Tmem132c_2
aggaagctataatcagcaca

SEQ ID NO: 61102 - DNA, 20 bp, Artificial Sequence
  sgRNA
  Tmem132c_3
ggaagagaatagcaccctga

SEQ ID NO: 61103 - DNA, 20 bp, Artificial Sequence
  sgRNA
  Tmem132c_4
tagctgacgtttaataccgg

SEQ ID NO: 61104 - DNA, 20 bp, Artificial Sequence
  sgRNA
  Tmem132c_5
acacgaccatcatagaccga

SEQ ID NO: 61105 - DNA, 20 bp, Artificial Sequence
  sgRNA
  Tmem132c_6
ggttcaacatcaagtccaga

SEQ ID NO: 61106 - DNA, 20 bp, Artificial Sequence
  sgRNA
  Tmem132c_7
agaaccatgccagtgaccgt

SEQ ID NO: 61107 - DNA, 20 bp, Artificial Sequence
  sgRNA
  Tmem132c_8
tgataggctgtgtccccgag

SEQ ID NO: 61108 - DNA, 20 bp, Artificial Sequence
  sgRNA
  Tmem132c_9
gcttcataaagtcagccacc

SEQ ID NO: 61109 - DNA, 20 bp, Artificial Sequence
  sgRNA
  Tmem132c_10
ggaactgcagggtacaaccc

SEQ ID NO: 61110 - DNA, 20 bp, Artificial Sequence
  sgRNA
  Tmem132c_11
gtacagccaggggacgagcg

SEQ ID NO: 61111 - DNA, 20 bp, Artificial Sequence
  sgRNA
  Tmem132c_12
tgcctcacatcccactgccg

SEQ ID NO: 61112 - DNA, 20 bp, Artificial Sequence
  sgRNA
  Tmem132c_13
aagctcacgggcaggtacgg

SEQ ID NO: 61113 - DNA, 20 bp, Artificial Sequence
  sgRNA
  Tmem132c_14
atagctgacgtttaataccg

SEQ ID NO: 61114 - DNA, 20 bp, Artificial Sequence
  sgRNA
  Tmem132c_15
gctgctacgtgccccaaaaa

SEQ ID NO: 61115 - DNA, 20 bp, Artificial Sequence
  sgRNA
  Tmem132c_16
gatccccaggaaagttgcca

SEQ ID NO: 61116 - DNA, 20 bp, Artificial Sequence
  sgRNA
  Tmem132c_17
ctcgccttggtggcccaccg

SEQ ID NO: 61117 - DNA, 20 bp, Artificial Sequence
  sgRNA
  Tmem132c_18
gctccttcttcacgatcccc

SEQ ID NO: 61118 - DNA, 20 bp, Artificial Sequence
  sgRNA
  Tmem132c_19
gtatattatccatgacccct

SEQ ID NO: 61119 - DNA, 20 bp, Artificial Sequence
  sgRNA
  Tmem132c_20
cacacgaccatcatagaccg

SEQ ID NO: 61120 - DNA, 20 bp, Artificial Sequence
  sgRNA
  Tmem132d_1
attatgtccctaagactgtg

SEQ ID NO: 61121 - DNA, 20 bp, Artificial Sequence
  sgRNA
  Tmem132d_2
gcatgaccactattcaggtg

SEQ ID NO: 61122 - DNA, 20 bp, Artificial Sequence
  sgRNA
  Tmem132d_3
caggtcatctgacgaagacg

SEQ ID NO: 61123 - DNA, 20 bp, Artificial Sequence
  sgRNA
  Tmem132d_4
agtcatgaagattgatatcg

SEQ ID NO: 61124 - DNA, 20 bp, Artificial Sequence
  sgRNA
  Tmem132d_5
aggcccacggagcagccaga

SEQ ID NO: 61125 - DNA, 20 bp, Artificial Sequence
  sgRNA
  Tmem132d_6
gctgataactgacttcatgc

SEQ ID NO: 61126 - DNA, 20 bp, Artificial Sequence
  sgRNA
  Tmem132d_7
tgatatggtaggtgaccggg

SEQ ID NO: 61127 - DNA, 20 bp, Artificial Sequence
  sgRNA
  Tmem132d_8
gctgctgtagaatggcccct

SEQ ID NO: 61128 - DNA, 20 bp, Artificial Sequence
  sgRNA
  Tmem132d_9
gctgaaggcctacatcctgc

SEQ ID NO: 61129 - DNA, 20 bp, Artificial Sequence
  sgRNA
  Tmem132d_10
ctgcagaagttcctgagcca

SEQ ID NO: 61130 - DNA, 20 bp, Artificial Sequence
  sgRNA
  Tmem132d_11
cggccatctcctcagacgat

SEQ ID NO: 61131 - DNA, 20 bp, Artificial Sequence
  sgRNA
  Tmem132d_12
tttcttctgacaaacgatga

SEQ ID NO: 61132 - DNA, 20 bp, Artificial Sequence
  sgRNA
  Tmem132d_13
ccagcacctgagcagccccc

SEQ ID NO: 61133 - DNA, 20 bp, Artificial Sequence
  sgRNA
  Tmem132d_14
gatgatgagaagaagggccg

SEQ ID NO: 61134 - DNA, 20 bp, Artificial Sequence
  sgRNA
  Tmem132d_15
tcaatctgcagaggtagccg

SEQ ID NO: 61135 - DNA, 20 bp, Artificial Sequence
  sgRNA
  Tmem132d_16
tctgagtcactctcacgact

SEQ ID NO: 61136 - DNA, 20 bp, Artificial Sequence
  sgRNA
  Tmem132d_17
gagcatacatgccaatttcg

SEQ ID NO: 61137 - DNA, 20 bp, Artificial Sequence
  sgRNA
  Tmem132d_18
ctacaaatctaggcgactgc

SEQ ID NO: 61138 - DNA, 20 bp, Artificial Sequence
  sgRNA
  Tmem132d_19
gtgtccttctgggaacacca

SEQ ID NO: 61139 - DNA, 20 bp, Artificial Sequence
  sgRNA
  Tmem132d_20
gatggggcagtaccaccaag

SEQ ID NO: 61140 - DNA, 20 bp, Artificial Sequence
  sgRNA
  Tmem132e_1
acgacttcggggtcaccgag

SEQ ID NO: 61141 - DNA, 20 bp, Artificial Sequence
  sgRNA
  Tmem132e_2
ggcttcttgcagatgccgcg

SEQ ID NO: 61142 - DNA, 20 bp, Artificial Sequence
  sgRNA
  Tmem132e_3
atgtggcacatcgattaccg

SEQ ID NO: 61143 - DNA, 20 bp, Artificial Sequence
  sgRNA
  Tmem132e_4
cacaagcgcatccctcccga

SEQ ID NO: 61144 - DNA, 20 bp, Artificial Sequence
  sgRNA
  Tmem132e_5
ggacatccccgagcgcttga

SEQ ID NO: 61145 - DNA, 20 bp, Artificial Sequence
  sgRNA
  Tmem132e_6
tctaggtccgtcagcccccg

SEQ ID NO: 61146 - DNA, 20 bp, Artificial Sequence
  sgRNA
  Tmem132e_7
agatggcttggacatccctt

SEQ ID NO: 61147 - DNA, 20 bp, Artificial Sequence
  sgRNA
  Tmem132e_8
gggctgacggacctagagat

SEQ ID NO: 61148 - DNA, 20 bp, Artificial Sequence
  sgRNA
  Tmem132e_9
ttaggcaccaagtctcgaag

SEQ ID NO: 61149 - DNA, 20 bp, Artificial Sequence
  sgRNA
  Tmem132e_10
gggctagcctgagttcccgg

SEQ ID NO: 61150 - DNA, 20 bp, Artificial Sequence
  sgRNA
  Tmem132e_11
tccgcacctcccgtgcatcg

SEQ ID NO: 61151 - DNA, 20 bp, Artificial Sequence
  sgRNA
  Tmem132e_12
gcgggaatggcagtgccggg

SEQ ID NO: 61152 - DNA, 20 bp, Artificial Sequence
  sgRNA
  Tmem132e_13
tactggtctggccctcggga

SEQ ID NO: 61153 - DNA, 20 bp, Artificial Sequence
  sgRNA
  Tmem132e_14
cttggtttggaacaccacga

SEQ ID NO: 61154 - DNA, 20 bp, Artificial Sequence
  sgRNA
  Tmem132e_15
ccttcttcctaaaggaagcg

SEQ ID NO: 61155 - DNA, 20 bp, Artificial Sequence
  sgRNA
  Tmem132e_16
ggcatctgcaagaagccggt

SEQ ID NO: 61156 - DNA, 20 bp, Artificial Sequence
  sgRNA
  Tmem132e_17
tatggaccattctcaccact

SEQ ID NO: 61157 - DNA, 20 bp, Artificial Sequence
  sgRNA
  Tmem132e_18
atcccacatacgactaccca

SEQ ID NO: 61158 - DNA, 20 bp, Artificial Sequence
  sgRNA
  Tmem132e_19
tctgagagctcgatgtgcag

SEQ ID NO: 61159 - DNA, 20 bp, Artificial Sequence
  sgRNA
  Tmem132e_20
ggtggtatcccccctgactg

SEQ ID NO: 61160 - DNA, 20 bp, Artificial Sequence
  sgRNA
  Tmem140_1
tcaggctaggtaggtcagcg

SEQ ID NO: 61161 - DNA, 20 bp, Artificial Sequence
  sgRNA
  Tmem140_2
aggatcatgatgcccacgaa

SEQ ID NO: 61162 - DNA, 20 bp, Artificial Sequence
  sgRNA
  Tmem140_3
tgcccagtacaacagagatg

SEQ ID NO: 61163 - DNA, 20 bp, Artificial Sequence
  sgRNA
  Tmem140_4
gggaaagttgtaacatgcta

SEQ ID NO: 61164 - DNA, 20 bp, Artificial Sequence
  sgRNA
  Tmem140_5
ttcttgtcctccttatcccg

SEQ ID NO: 61165 - DNA, 20 bp, Artificial Sequence
  sgRNA
  Tmem140_6
ccgtggcgggaacctaaccg

SEQ ID NO: 61166 - DNA, 20 bp, Artificial Sequence
  sgRNA
  Tmem140_7
acagaatggaggatgccgcc

SEQ ID NO: 61167 - DNA, 20 bp, Artificial Sequence
  sgRNA
  Tmem140_8
ccacggttaggttcccgcca

SEQ ID NO: 61168 - DNA, 20 bp, Artificial Sequence
  sgRNA
  Tmem140_9
gcatcctccattctgttggc

SEQ ID NO: 61169 - DNA, 20 bp, Artificial Sequence
  sgRNA
  Tmem140_10
gacctacctagcctgagaat

SEQ ID NO: 61170 - DNA, 20 bp, Artificial Sequence
  sgRNA
  Tmem140_11
gccacttccacacgaaggag

SEQ ID NO: 61171 - DNA, 20 bp, Artificial Sequence
  sgRNA
  Tmem140_12
atacacaccgagcctggcca

SEQ ID NO: 61172 - DNA, 20 bp, Artificial Sequence
  sgRNA
  Tmem140_13
ttgtcctccttatcccgtgg

SEQ ID NO: 61173 - DNA, 20 bp, Artificial Sequence
  sgRNA
  Tmem140_14
tcctccggccaacagaatgg

SEQ ID NO: 61174 - DNA, 20 bp, Artificial Sequence
  sgRNA
  Tmem140_15
gctggccgtgtgcttcctgg

SEQ ID NO: 61175 - DNA, 20 bp, Artificial Sequence
  sgRNA
  Tmem140_16
catcatgatcctcttggccg

SEQ ID NO: 61176 - DNA, 20 bp, Artificial Sequence
  sgRNA
  Tmem140_17
ggacgtgctgggcattcctc

SEQ ID NO: 61177 - DNA, 20 bp, Artificial Sequence
  sgRNA
  Tmem140_18
cgaggttgccagccttccag

SEQ ID NO: 61178 - DNA, 20 bp, Artificial Sequence
  sgRNA
  Tmem140_19
cctgagccacttccacacga

SEQ ID NO: 61179 - DNA, 20 bp, Artificial Sequence
  sgRNA
  Tmem140_20
gcaagaagatgagtaacagc

SEQ ID NO: 61180 - DNA, 20 bp, Artificial Sequence
  sgRNA
  Tmem145_1
cttccgattccgataccccg

SEQ ID NO: 61181 - DNA, 20 bp, Artificial Sequence
  sgRNA
  Tmem145_2
tcaccgtgaatcccttcccg

SEQ ID NO: 61182 - DNA, 20 bp, Artificial Sequence
  sgRNA
  Tmem145_3
acccgggccaagtacgtgcg

SEQ ID NO: 61183 - DNA, 20 bp, Artificial Sequence
  sgRNA
  Tmem145_4
cttctctggatagtgccgaa

SEQ ID NO: 61184 - DNA, 20 bp, Artificial Sequence
  sgRNA
  Tmem145_5
ccagtcgtccataatccgaa

SEQ ID NO: 61185 - DNA, 20 bp, Artificial Sequence
  sgRNA
  Tmem145_6
actttgacgacccatcccag

SEQ ID NO: 61186 - DNA, 20 bp, Artificial Sequence
  sgRNA
  Tmem145_7
cgatctgtgaagttcgcacg

SEQ ID NO: 61187 - DNA, 20 bp, Artificial Sequence
  sgRNA
  Tmem145_8
gcccgaccaggcgtactgag

SEQ ID NO: 61188 - DNA, 20 bp, Artificial Sequence
  sgRNA
  Tmem145_9
tggcgatcagagccatgacg

SEQ ID NO: 61189 - DNA, 20 bp, Artificial Sequence
  sgRNA
  Tmem145_10
gttcggccatggtcaccaca

SEQ ID NO: 61190 - DNA, 20 bp, Artificial Sequence
  sgRNA
  Tmem145_11
agttcttgttggccgccgat

SEQ ID NO: 61191 - DNA, 20 bp, Artificial Sequence
  sgRNA
  Tmem145_12
cgtggtgttgctcatctacg

SEQ ID NO: 61192 - DNA, 20 bp, Artificial Sequence
  sgRNA
  Tmem145_13
tatgagatggtccttaccaa

SEQ ID NO: 61193 - DNA, 20 bp, Artificial Sequence
  sgRNA
  Tmem145_14
gggcggagatcacggaacag

SEQ ID NO: 61194 - DNA, 20 bp, Artificial Sequence
  sgRNA
  Tmem145_15
acccgctcggttctccaagg

SEQ ID NO: 61195 - DNA, 20 bp, Artificial Sequence
  sgRNA
  Tmem145_16
cgtagatgagcaacaccacg

SEQ ID NO: 61196 - DNA, 20 bp, Artificial Sequence
  sgRNA
  Tmem145_17
acactcatcctcctcgggaa

SEQ ID NO: 61197 - DNA, 20 bp, Artificial Sequence
  sgRNA
  Tmem145_18
gcccgagagaagatagtcaa

SEQ ID NO: 61198 - DNA, 20 bp, Artificial Sequence
  sgRNA
  Tmem145_19
gctgcagttggagtatgaga

SEQ ID NO: 61199 - DNA, 20 bp, Artificial Sequence
  sgRNA
  Tmem145_20
gggatgggtcgtcaaagtag

SEQ ID NO: 61200 - DNA, 20 bp, Artificial Sequence
  sgRNA
  Tmem150a_1
gccaagtctctacactacat

SEQ ID NO: 61201 - DNA, 20 bp, Artificial Sequence
  sgRNA
  Tmem150a_2
gcacacgtggcggttcatca

SEQ ID NO: 61202 - DNA, 20 bp, Artificial Sequence
  sgRNA
  Tmem150a_3
gaaaattgccgaccaccacg

SEQ ID NO: 61203 - DNA, 20 bp, Artificial Sequence
  sgRNA
  Tmem150a_4
taggccatagccatgtccag

SEQ ID NO: 61204 - DNA, 20 bp, Artificial Sequence
  sgRNA
  Tmem150a_5
tgaagaggcagctctccggg

SEQ ID NO: 61205 - DNA, 20 bp, Artificial Sequence
  sgRNA
  Tmem150a_6
tctccactgggcacacgtgg

SEQ ID NO: 61206 - DNA, 20 bp, Artificial Sequence
  sgRNA
  Tmem150a_7
tgtagtgtagagacttggca

SEQ ID NO: 61207 - DNA, 20 bp, Artificial Sequence
  sgRNA
  Tmem150a_8
agttctccactgggcacacg

SEQ ID NO: 61208 - DNA, 20 bp, Artificial Sequence
  sgRNA
  Tmem150a_9
tgacagccagcacacttcga

SEQ ID NO: 61209 - DNA, 20 bp, Artificial Sequence
  sgRNA
  Tmem150a_10
tagggcccccttgttcagca

SEQ ID NO: 61210 - DNA, 20 bp, Artificial Sequence
  sgRNA
  Tmem150a_11
ggacttacaggccctgcccg

SEQ ID NO: 61211 - DNA, 20 bp, Artificial Sequence
  sgRNA
  Tmem150a_12
ctcctgaccctgctgaacaa

SEQ ID NO: 61212 - DNA, 20 bp, Artificial Sequence
  sgRNA
  Tmem150a_13
gcaaccagtgatgagtgcag

SEQ ID NO: 61213 - DNA, 20 bp, Artificial Sequence
  sgRNA
  Tmem150a_14
gatgagaggaacatcatcca

SEQ ID NO: 61214 - DNA, 20 bp, Artificial Sequence
  sgRNA
  Tmem150a_15
gctgcaggcctcgtggtggt

SEQ ID NO: 61215 - DNA, 20 bp, Artificial Sequence
  sgRNA
  Tmem150a_16
aggccatagccatgtccagg

SEQ ID NO: 61216 - DNA, 20 bp, Artificial Sequence
  sgRNA
  Tmem150a_17
ggtagaagagaacacagtgc

SEQ ID NO: 61217 - DNA, 20 bp, Artificial Sequence
  sgRNA
  Tmem150a_18
caacgctgcaggcctcgtgg

SEQ ID NO: 61218 - DNA, 20 bp, Artificial Sequence
  sgRNA
  Tmem150a_19
aataccactgcactcatcac

SEQ ID NO: 61219 - DNA, 20 bp, Artificial Sequence
  sgRNA
  Tmem150a_20
ggagctgagaactctcgtgg

SEQ ID NO: 61220 - DNA, 20 bp, Artificial Sequence
  sgRNA
  Tmem150b_1
cgtagagacttaatccagtg

SEQ ID NO: 61221 - DNA, 20 bp, Artificial Sequence
  sgRNA
  Tmem150b_2
tggccgaaaatgcagctctg

SEQ ID NO: 61222 - DNA, 20 bp, Artificial Sequence
  sgRNA
  Tmem150b_3
ggcaaaaccagctaattctg

SEQ ID NO: 61223 - DNA, 20 bp, Artificial Sequence
  sgRNA
  Tmem150b_4
gccctgggtacctccatagt

SEQ ID NO: 61224 - DNA, 20 bp, Artificial Sequence
  sgRNA
  Tmem150b_5
tacccactcgcagatagccg

SEQ ID NO: 61225 - DNA, 20 bp, Artificial Sequence
  sgRNA
  Tmem150b_6
ggttctgtggacctcaacga

SEQ ID NO: 61226 - DNA, 20 bp, Artificial Sequence
  sgRNA
  Tmem150b_7
gcgtagagacttaatccagt

SEQ ID NO: 61227 - DNA, 20 bp, Artificial Sequence
  sgRNA
  Tmem150b_8
cgaggcagagcgcatatgta

SEQ ID NO: 61228 - DNA, 20 bp, Artificial Sequence
  sgRNA
  Tmem150b_9
gctatttggcttctttgccg

SEQ ID NO: 61229 - DNA, 20 bp, Artificial Sequence
  sgRNA
  Tmem150b_10
acgcaaaatggagaagtcca

SEQ ID NO: 61230 - DNA, 20 bp, Artificial Sequence
  sgRNA
  Tmem150b_11
ggcgtagagacttaatccag

SEQ ID NO: 61231 - DNA, 20 bp, Artificial Sequence
  sgRNA
  Tmem150b_12
ttagagcagctcctatattg

SEQ ID NO: 61232 - DNA, 20 bp, Artificial Sequence
  sgRNA
  Tmem150b_13
ttatttctgtgggctatagc

SEQ ID NO: 61233 - DNA, 20 bp, Artificial Sequence
  sgRNA
  Tmem150b_14
gcctactatggaggtaccca

SEQ ID NO: 61234 - DNA, 20 bp, Artificial Sequence
  sgRNA
  Tmem150b_15
taaaagggaagccttcgttg

SEQ ID NO: 61235 - DNA, 20 bp, Artificial Sequence
  sgRNA
  Tmem150b_16
gtctctcttgaccagctttg

SEQ ID NO: 61236 - DNA, 20 bp, Artificial Sequence
  sgRNA
  Tmem150b_17
gcccacagaaataagatgac

SEQ ID NO: 61237 - DNA, 20 bp, Artificial Sequence
  sgRNA
  Tmem150b_18
tgggtctccaaatatacaga

SEQ ID NO: 61238 - DNA, 20 bp, Artificial Sequence
  sgRNA
  Tmem150b_19
tgaccagctttggggtattg

SEQ ID NO: 61239 - DNA, 20 bp, Artificial Sequence
  sgRNA
  Tmem150b_20
agaagcccacacacttggca

SEQ ID NO: 61240 - DNA, 20 bp, Artificial Sequence
  sgRNA
  Tmem154_1
aaaagcaagagacctaagca

SEQ ID NO: 61241 - DNA, 20 bp, Artificial Sequence
  sgRNA
  Tmem154_2
gacgaggagtcagaatactc

SEQ ID NO: 61242 - DNA, 20 bp, Artificial Sequence
  sgRNA
  Tmem154_3
ccattaatataaattccacc

SEQ ID NO: 61243 - DNA, 20 bp, Artificial Sequence
  sgRNA
  Tmem154_4
ttgaccaaacgcgagcccca

SEQ ID NO: 61244 - DNA, 20 bp, Artificial Sequence
  sgRNA
  Tmem154_5
gcgtttggtcaatccagcca

SEQ ID NO: 61245 - DNA, 20 bp, Artificial Sequence
  sgRNA
  Tmem154_6
atctctatttccataacaga

SEQ ID NO: 61246 - DNA, 20 bp, Artificial Sequence
  sgRNA
  Tmem154_7
gccaagaccaacgcagcaca

SEQ ID NO: 61247 - DNA, 20 bp, Artificial Sequence
  sgRNA
  Tmem154_8
agtaggtaaacactcatagt

SEQ ID NO: 61248 - DNA, 20 bp, Artificial Sequence
  sgRNA
  Tmem154_9
ggatgagcagcgcagccagt

SEQ ID NO: 61249 - DNA, 20 bp, Artificial Sequence
  sgRNA
  Tmem154_10
agatggaagagcttgataaa

SEQ ID NO: 61250 - DNA, 20 bp, Artificial Sequence
  sgRNA
  Tmem154_11
gtgtgtcctcttcaaaaata

SEQ ID NO: 61251 - DNA, 20 bp, Artificial Sequence
  sgRNA
  Tmem154_12
gtttgaggtgtcgttggtgt

SEQ ID NO: 61252 - DNA, 20 bp, Artificial Sequence
  sgRNA
  Tmem154_13
ggtggaatttatattaatgg

SEQ ID NO: 61253 - DNA, 20 bp, Artificial Sequence
  sgRNA
  Tmem154_14
gacgagaagtgctctggcta

SEQ ID NO: 61254 - DNA, 20 bp, Artificial Sequence
  sgRNA
  Tmem154_15
attaatggtggcgatcccac

SEQ ID NO: 61255 - DNA, 20 bp, Artificial Sequence
  sgRNA
  Tmem154_16
caacgacacctcaaaccagg

SEQ ID NO: 61256 - DNA, 20 bp, Artificial Sequence
  sgRNA
  Tmem154_17
catctctatttccataacag

SEQ ID NO: 61257 - DNA, 20 bp, Artificial Sequence
  sgRNA
  Tmem154_18
cacagaagaagaaaactcgg

SEQ ID NO: 61258 - DNA, 20 bp, Artificial Sequence
  sgRNA
  Tmem154_19
caccaacgacacctcaaacc

SEQ ID NO: 61259 - DNA, 20 bp, Artificial Sequence
  sgRNA
  Tmem154_20
catcacagaagaagaaaact

SEQ ID NO: 61260 - DNA, 20 bp, Artificial Sequence
  sgRNA
  Tmem158_1
agggacgcccccaaacgcct

SEQ ID NO: 61261 - DNA, 20 bp, Artificial Sequence
  sgRNA
  Tmem158_2
ctcttctctaccaacgcgca

SEQ ID NO: 61262 - DNA, 20 bp, Artificial Sequence
  sgRNA
  Tmem158_3
agatgctcgatgagcagtgg

SEQ ID NO: 61263 - DNA, 20 bp, Artificial Sequence
  sgRNA
  Tmem158_4
cgttgcacgctgatgttgca

SEQ ID NO: 61264 - DNA, 20 bp, Artificial Sequence
  sgRNA
  Tmem158_5
gctccacaccacgatgacca

SEQ ID NO: 61265 - DNA, 20 bp, Artificial Sequence
  sgRNA
  Tmem158_6
gcattggccgaggcgtttgg

SEQ ID NO: 61266 - DNA, 20 bp, Artificial Sequence
  sgRNA
  Tmem158_7
gccaccagcgtagactcgat

SEQ ID NO: 61267 - DNA, 20 bp, Artificial Sequence
  sgRNA
  Tmem158_8
tgagcagtggtggcccgacg

SEQ ID NO: 61268 - DNA, 20 bp, Artificial Sequence
  sgRNA
  Tmem158_9
aggtcgcactgcaagccccg

SEQ ID NO: 61269 - DNA, 20 bp, Artificial Sequence
  sgRNA
  Tmem158_10
acgcggggtggagtgttcgt

SEQ ID NO: 61270 - DNA, 20 bp, Artificial Sequence
  sgRNA
  Tmem158_11
ggtgaaggacgcattggccg

SEQ ID NO: 61271 - DNA, 20 bp, Artificial Sequence
  sgRNA
  Tmem158_12
aagccggcaatgatgggcac

SEQ ID NO: 61272 - DNA, 20 bp, Artificial Sequence
  sgRNA
  Tmem158_13
cccagatgctcgatgagcag

SEQ ID NO: 61273 - DNA, 20 bp, Artificial Sequence
  sgRNA
  Tmem158_14
attgccggcttcctgcccaa

SEQ ID NO: 61274 - DNA, 20 bp, Artificial Sequence
  sgRNA
  Tmem158_15
agctcgctgctcgtgcgctg

SEQ ID NO: 61275 - DNA, 20 bp, Artificial Sequence
  sgRNA
  Tmem158_16
cggcgctgctccatgccgtt

SEQ ID NO: 61276 - DNA, 20 bp, Artificial Sequence
  sgRNA
  Tmem158_17
ttcgttggtgaaggacgcat

SEQ ID NO: 61277 - DNA, 20 bp, Artificial Sequence
  sgRNA
  Tmem158_18
ggtggagtgttcgttggtga

SEQ ID NO: 61278 - DNA, 20 bp, Artificial Sequence
  sgRNA
  Tmem158_19
ccaacggcatggagcagcgc

SEQ ID NO: 61279 - DNA, 20 bp, Artificial Sequence
  sgRNA
  Tmem158_20
gccagtagcgcggcgagaag

SEQ ID NO: 61280 - DNA, 20 bp, Artificial Sequence
  sgRNA
  Tmem161a_1
aggcccgtgaaatccagcag

SEQ ID NO: 61281 - DNA, 20 bp, Artificial Sequence
  sgRNA
  Tmem161a_2
ctagcaccgccagcccaagg

SEQ ID NO: 61282 - DNA, 20 bp, Artificial Sequence
  sgRNA
  Tmem161a_3
ttgttgcagaccgtcagaag

SEQ ID NO: 61283 - DNA, 20 bp, Artificial Sequence
  sgRNA
  Tmem161a_4
ggacgcgctgaccctgtctg

SEQ ID NO: 61284 - DNA, 20 bp, Artificial Sequence
  sgRNA
  Tmem161a_5
ggtattccagaaagaagcgc

SEQ ID NO: 61285 - DNA, 20 bp, Artificial Sequence
  sgRNA
  Tmem161a_6
acagcgccaccaacacccag

SEQ ID NO: 61286 - DNA, 20 bp, Artificial Sequence
  sgRNA
  Tmem161a_7
cttggtactgaagtacagcc

SEQ ID NO: 61287 - DNA, 20 bp, Artificial Sequence
  sgRNA
  Tmem161a_8
agactgcagcccaggttgca

SEQ ID NO: 61288 - DNA, 20 bp, Artificial Sequence
  sgRNA
  Tmem161a_9
gtaccagcatggccaagagg

SEQ ID NO: 61289 - DNA, 20 bp, Artificial Sequence
  sgRNA
  Tmem161a_10
ggatggccaacttgatcaca

SEQ ID NO: 61290 - DNA, 20 bp, Artificial Sequence
  sgRNA
  Tmem161a_11
ggtctactgctacgtgactg

SEQ ID NO: 61291 - DNA, 20 bp, Artificial Sequence
  sgRNA
  Tmem161a_12
gctccactcgagccttggcc

SEQ ID NO: 61292 - DNA, 20 bp, Artificial Sequence
  sgRNA
  Tmem161a_13
tgtgaagaggtacacaccaa

SEQ ID NO: 61293 - DNA, 20 bp, Artificial Sequence
  sgRNA
  Tmem161a_14
cctctgacgggtgtatgtac

SEQ ID NO: 61294 - DNA, 20 bp, Artificial Sequence
  sgRNA
  Tmem161a_15
acactgctgctcaagaccct

SEQ ID NO: 61295 - DNA, 20 bp, Artificial Sequence
  sgRNA
  Tmem161a_16
gctggtacaggtggtgcggg

SEQ ID NO: 61296 - DNA, 20 bp, Artificial Sequence
  sgRNA
  Tmem161a_17
ggatttcacgggcctcaatg

SEQ ID NO: 61297 - DNA, 20 bp, Artificial Sequence
  sgRNA
  Tmem161a_18
gtacatacacccgtcagagg

SEQ ID NO: 61298 - DNA, 20 bp, Artificial Sequence
  sgRNA
  Tmem161a_19
gctgtacttcagtaccaagg

SEQ ID NO: 61299 - DNA, 20 bp, Artificial Sequence
  sgRNA
  Tmem161a_20
ggtgtggccgggttactgcc

SEQ ID NO: 61300 - DNA, 20 bp, Artificial Sequence
  sgRNA
  Tmem171_1
atgtgactcagattgggcac

SEQ ID NO: 61301 - DNA, 20 bp, Artificial Sequence
  sgRNA
  Tmem171_2
tatgctaatgagcatgccac

SEQ ID NO: 61302 - DNA, 20 bp, Artificial Sequence
  sgRNA
  Tmem171_3
aggtggacacgcccacagca

SEQ ID NO: 61303 - DNA, 20 bp, Artificial Sequence
  sgRNA
  Tmem171_4
gaaggagaaccccagatctg

SEQ ID NO: 61304 - DNA, 20 bp, Artificial Sequence
  sgRNA
  Tmem171_5
agtcccacaagcacaaccaa

SEQ ID NO: 61305 - DNA, 20 bp, Artificial Sequence
  sgRNA
  Tmem171_6
gcatcagaaggggcacccaa

SEQ ID NO: 61306 - DNA, 20 bp, Artificial Sequence
  sgRNA
  Tmem171_7
gagctcctgttctctctcag

SEQ ID NO: 61307 - DNA, 20 bp, Artificial Sequence
  sgRNA
  Tmem171_8
ctttcctgagtcttcagcag

SEQ ID NO: 61308 - DNA, 20 bp, Artificial Sequence
  sgRNA
  Tmem171_9
gtgcaggctgttagccccag

SEQ ID NO: 61309 - DNA, 20 bp, Artificial Sequence
  sgRNA
  Tmem171_10
gtgtccaccttcgacctcag

SEQ ID NO: 61310 - DNA, 20 bp, Artificial Sequence
  sgRNA
  Tmem171_11
actatgctgcagtgtgagag

SEQ ID NO: 61311 - DNA, 20 bp, Artificial Sequence
  sgRNA
  Tmem171_12
gatacctctgaggtcgaagg

SEQ ID NO: 61312 - DNA, 20 bp, Artificial Sequence
  sgRNA
  Tmem171_13
tgagacactgggcaaactgg

SEQ ID NO: 61313 - DNA, 20 bp, Artificial Sequence
  sgRNA
  Tmem171_14
gagcctgtccacatcactgt

SEQ ID NO: 61314 - DNA, 20 bp, Artificial Sequence
  sgRNA
  Tmem171_15
tccagtgtatgatctctccg

SEQ ID NO: 61315 - DNA, 20 bp, Artificial Sequence
  sgRNA
  Tmem171_16
tgagccagatggagaccaga

SEQ ID NO: 61316 - DNA, 20 bp, Artificial Sequence
  sgRNA
  Tmem171_17
gccccatgatctgcagagaa

SEQ ID NO: 61317 - DNA, 20 bp, Artificial Sequence
  sgRNA
  Tmem171_18
ggatgaaccctgcccagaaa

SEQ ID NO: 61318 - DNA, 20 bp, Artificial Sequence
  sgRNA
  Tmem171_19
ggtgcaggctgttagcccca

SEQ ID NO: 61319 - DNA, 20 bp, Artificial Sequence
  sgRNA
  Tmem171_20
aggcccaccactgcacacga

SEQ ID NO: 61320 - DNA, 20 bp, Artificial Sequence
  sgRNA
  Tmem178_1
gggggtcggtctcgtaccag

SEQ ID NO: 61321 - DNA, 20 bp, Artificial Sequence
  sgRNA
  Tmem178_2
ggcggttcttctgatccggg

SEQ ID NO: 61322 - DNA, 20 bp, Artificial Sequence
  sgRNA
  Tmem178_3
ggcgggttggacgctgagtg

SEQ ID NO: 61323 - DNA, 20 bp, Artificial Sequence
  sgRNA
  Tmem178_4
tgcgggactcgcctcccctg

SEQ ID NO: 61324 - DNA, 20 bp, Artificial Sequence
  sgRNA
  Tmem178_5
ttagatgtgcaatcttcgtc

SEQ ID NO: 61325 - DNA, 20 bp, Artificial Sequence
  sgRNA
  Tmem178_6
ggtgcgacagcggcatcagg

SEQ ID NO: 61326 - DNA, 20 bp, Artificial Sequence
  sgRNA
  Tmem178_7
tgtctcctatgacttgaacc

SEQ ID NO: 61327 - DNA, 20 bp, Artificial Sequence
  sgRNA
  Tmem178_8
actcagggtctgagcgcccg

SEQ ID NO: 61328 - DNA, 20 bp, Artificial Sequence
  sgRNA
  Tmem178_9
ctcccagaagaagctgaccg

SEQ ID NO: 61329 - DNA, 20 bp, Artificial Sequence
  sgRNA
  Tmem178_10
ggaaagcctgacccagcacg

SEQ ID NO: 61330 - DNA, 20 bp, Artificial Sequence
  sgRNA
  Tmem178_11
gtcggtctcgtaccagtggt

SEQ ID NO: 61331 - DNA, 20 bp, Artificial Sequence
  sgRNA
  Tmem178_12
actgcaccaggcacaaaaga

SEQ ID NO: 61332 - DNA, 20 bp, Artificial Sequence
  sgRNA
  Tmem178_13
ggactcctattcctcatgac

SEQ ID NO: 61333 - DNA, 20 bp, Artificial Sequence
  sgRNA
  Tmem178_14
ggacagccaccgccatgccc

SEQ ID NO: 61334 - DNA, 20 bp, Artificial Sequence
  sgRNA
  Tmem178_15
tcgcttatccgtttattagc

SEQ ID NO: 61335 - DNA, 20 bp, Artificial Sequence
  sgRNA
  Tmem178_16
gcctcagcctttgctccctg

SEQ ID NO: 61336 - DNA, 20 bp, Artificial Sequence
  sgRNA
  Tmem178_17
cccgagtaggtggcgaacag

SEQ ID NO: 61337 - DNA, 20 bp, Artificial Sequence
  sgRNA
  Tmem178_18
gttcaagtcataggagacac

SEQ ID NO: 61338 - DNA, 20 bp, Artificial Sequence
  sgRNA
  Tmem178_19
catgttccacatcatgaggc

SEQ ID NO: 61339 - DNA, 20 bp, Artificial Sequence
  sgRNA
  Tmem178_20
gctactttctgggcatcgac

SEQ ID NO: 61340 - DNA, 20 bp, Artificial Sequence
  sgRNA
  Tmem178b_1
ggagtccgtataggtagcgt

SEQ ID NO: 61341 - DNA, 20 bp, Artificial Sequence
  sgRNA
  Tmem178b_2
ccgaggccttatgcagtacg

SEQ ID NO: 61342 - DNA, 20 bp, Artificial Sequence
  sgRNA
  Tmem178b_3
atgcagccttacctcccatg

SEQ ID NO: 61343 - DNA, 20 bp, Artificial Sequence
  sgRNA
  Tmem178b_4
catttcactgtgcacatgtg

SEQ ID NO: 61344 - DNA, 20 bp, Artificial Sequence
  sgRNA
  Tmem178b_5
cctctgtccaacctgtcccg

SEQ ID NO: 61345 - DNA, 20 bp, Artificial Sequence
  sgRNA
  Tmem178b_6
acatggaccatccatagcca

SEQ ID NO: 61346 - DNA, 20 bp, Artificial Sequence
  sgRNA
  Tmem178b_7
catcacgaagaccattcgcc

SEQ ID NO: 61347 - DNA, 20 bp, Artificial Sequence
  sgRNA
  Tmem178b_8
tgtcatccgggagtccgtat

SEQ ID NO: 61348 - DNA, 20 bp, Artificial Sequence
  sgRNA
  Tmem178b_9
attccgagaggaacttacca

SEQ ID NO: 61349 - DNA, 20 bp, Artificial Sequence
  sgRNA
  Tmem178b_10
gggagtccgtataggtagcg

SEQ ID NO: 61350 - DNA, 20 bp, Artificial Sequence
  sgRNA
  Tmem178b_11
gcacagtgaaatgatgcaga

SEQ ID NO: 61351 - DNA, 20 bp, Artificial Sequence
  sgRNA
  Tmem178b_12
tgttgaatgtgaggttccta

SEQ ID NO: 61352 - DNA, 20 bp, Artificial Sequence
  sgRNA
  Tmem178b_13
gatgacatcagccatggcta

SEQ ID NO: 61353 - DNA, 20 bp, Artificial Sequence
  sgRNA
  Tmem178b_14
actcctcagcaaccatccct

SEQ ID NO: 61354 - DNA, 20 bp, Artificial Sequence
  sgRNA
  Tmem178b_15
gcagtggccatcatcctctt

SEQ ID NO: 61355 - DNA, 20 bp, Artificial Sequence
  sgRNA
  Tmem178b_16
gccttatgcagtacgtggca

SEQ ID NO: 61356 - DNA, 20 bp, Artificial Sequence
  sgRNA
  Tmem178b_17
ccacgtactgcataaggcct

SEQ ID NO: 61357 - DNA, 20 bp, Artificial Sequence
  sgRNA
  Tmem178b_18
gtgccactcatcctggcgaa

SEQ ID NO: 61358 - DNA, 20 bp, Artificial Sequence
  sgRNA
  Tmem178b_19
tctccgggtcgaagccctgc

SEQ ID NO: 61359 - DNA, 20 bp, Artificial Sequence
  sgRNA
  Tmem178b_20
gatcttcgtagaatgacagc

SEQ ID NO: 61360 - DNA, 20 bp, Artificial Sequence
  sgRNA
  Tmem182_1
actaattgcggagtcgtagg

SEQ ID NO: 61361 - DNA, 20 bp, Artificial Sequence
  sgRNA
  Tmem182_2
aagccaataatccgatccaa

SEQ ID NO: 61362 - DNA, 20 bp, Artificial Sequence
  sgRNA
  Tmem182_3
tcccctcatgaaggggtacg

SEQ ID NO: 61363 - DNA, 20 bp, Artificial Sequence
  sgRNA
  Tmem182_4
cacttcctttataaagctgg

SEQ ID NO: 61364 - DNA, 20 bp, Artificial Sequence
  sgRNA
  Tmem182_5
tgctctttctagttgttgga

SEQ ID NO: 61365 - DNA, 20 bp, Artificial Sequence
  sgRNA
  Tmem182_6
gcaggactgcccagaagcca

SEQ ID NO: 61366 - DNA, 20 bp, Artificial Sequence
  sgRNA
  Tmem182_7
gagagaagaatacgccagcg

SEQ ID NO: 61367 - DNA, 20 bp, Artificial Sequence
  sgRNA
  Tmem182_8
tgtgctctcccctcatgaag

SEQ ID NO: 61368 - DNA, 20 bp, Artificial Sequence
  sgRNA
  Tmem182_9
agagaagaatacgccagcgg

SEQ ID NO: 61369 - DNA, 20 bp, Artificial Sequence
  sgRNA
  Tmem182_10
ccagccgtacaggatggaag

SEQ ID NO: 61370 - DNA, 20 bp, Artificial Sequence
  sgRNA
  Tmem182_11
gggctgctctttctagttgt

SEQ ID NO: 61371 - DNA, 20 bp, Artificial Sequence
  sgRNA
  Tmem182_12
gacatacagtatcaccacca

SEQ ID NO: 61372 - DNA, 20 bp, Artificial Sequence
  sgRNA
  Tmem182_13
gcgtgtgtgcagttcttgga

SEQ ID NO: 61373 - DNA, 20 bp, Artificial Sequence
  sgRNA
  Tmem182_14
gtccccgtaccccttcatga

SEQ ID NO: 61374 - DNA, 20 bp, Artificial Sequence
  sgRNA
  Tmem182_15
tggcttctcgcgactgaagt

SEQ ID NO: 61375 - DNA, 20 bp, Artificial Sequence
  sgRNA
  Tmem182_16
gaagagagccccaaagaaaa

SEQ ID NO: 61376 - DNA, 20 bp, Artificial Sequence
  sgRNA
  Tmem182_17
ggcagtcctgctgctcctgg

SEQ ID NO: 61377 - DNA, 20 bp, Artificial Sequence
  sgRNA
  Tmem182_18
cagagagaagaatacgccag

SEQ ID NO: 61378 - DNA, 20 bp, Artificial Sequence
  sgRNA
  Tmem182_19
gtatcaccaccagggaaaac

SEQ ID NO: 61379 - DNA, 20 bp, Artificial Sequence
  sgRNA
  Tmem182_20
aaacgaccagccgtacagga

SEQ ID NO: 61380 - DNA, 20 bp, Artificial Sequence
  sgRNA
  Tmem184a_1
tggagtaggacataccacgg

SEQ ID NO: 61381 - DNA, 20 bp, Artificial Sequence
  sgRNA
  Tmem184a_2
gcggggcggtataggaacgt

SEQ ID NO: 61382 - DNA, 20 bp, Artificial Sequence
  sgRNA
  Tmem184a_3
tgaccgaggcattgtacacg

SEQ ID NO: 61383 - DNA, 20 bp, Artificial Sequence
  sgRNA
  Tmem184a_4
ttgtgcttccaatatctggg

SEQ ID NO: 61384 - DNA, 20 bp, Artificial Sequence
  sgRNA
  Tmem184a_5
ggaaggcgtaacgcagcgcg

SEQ ID NO: 61385 - DNA, 20 bp, Artificial Sequence
  sgRNA
  Tmem184a_6
gaaggcgtaacgcagcgcga

SEQ ID NO: 61386 - DNA, 20 bp, Artificial Sequence
  sgRNA
  Tmem184a_7
gacgaagcgctgctctcgcg

SEQ ID NO: 61387 - DNA, 20 bp, Artificial Sequence
  sgRNA
  Tmem184a_8
gaccgaggcattgtacacga

SEQ ID NO: 61388 - DNA, 20 bp, Artificial Sequence
  sgRNA
  Tmem184a_9
ggctggcgagaagttatgaa

SEQ ID NO: 61389 - DNA, 20 bp, Artificial Sequence
  sgRNA
  Tmem184a_10
gcgtggacaacggctcgcag

SEQ ID NO: 61390 - DNA, 20 bp, Artificial Sequence
  sgRNA
  Tmem184a_11
tgtacacgagggtcacgtac

SEQ ID NO: 61391 - DNA, 20 bp, Artificial Sequence
  sgRNA
  Tmem184a_12
gctcttcctcaccagcgcat

SEQ ID NO: 61392 - DNA, 20 bp, Artificial Sequence
  sgRNA
  Tmem184a_13
tctctgaatacacctggctg

SEQ ID NO: 61393 - DNA, 20 bp, Artificial Sequence
  sgRNA
  Tmem184a_14
ggcggtataggaacgtaggt

SEQ ID NO: 61394 - DNA, 20 bp, Artificial Sequence
  sgRNA
  Tmem184a_15
cagatggagcgcgtggacaa

SEQ ID NO: 61395 - DNA, 20 bp, Artificial Sequence
  sgRNA
  Tmem184a_16
tgatggagtaggacatacca

SEQ ID NO: 61396 - DNA, 20 bp, Artificial Sequence
  sgRNA
  Tmem184a_17
cgtcctggacaatgtcctgt

SEQ ID NO: 61397 - DNA, 20 bp, Artificial Sequence
  sgRNA
  Tmem184a_18
agatgggcacaatgaacagg

SEQ ID NO: 61398 - DNA, 20 bp, Artificial Sequence
  sgRNA
  Tmem184a_19
gcagaagcgtaagaacgtga

SEQ ID NO: 61399 - DNA, 20 bp, Artificial Sequence
  sgRNA
  Tmem184a_20
aacttgagtaccggctcgaa

SEQ ID NO: 61400 - DNA, 20 bp, Artificial Sequence
  sgRNA
  Tmem204_1
cgtctggtacacccaattgg

SEQ ID NO: 61401 - DNA, 20 bp, Artificial Sequence
  sgRNA
  Tmem204_2
ggggcaggcccgttagccca

SEQ ID NO: 61402 - DNA, 20 bp, Artificial Sequence
  sgRNA
  Tmem204_3
gtaagggagtcacaagccct

SEQ ID NO: 61403 - DNA, 20 bp, Artificial Sequence
  sgRNA
  Tmem204_4
acttacgtttgacggtgcct

SEQ ID NO: 61404 - DNA, 20 bp, Artificial Sequence
  sgRNA
  Tmem204_5
gcaggtttccaggagtcccg

SEQ ID NO: 61405 - DNA, 20 bp, Artificial Sequence
  sgRNA
  Tmem204_6
tctggaacattcttcaccgg

SEQ ID NO: 61406 - DNA, 20 bp, Artificial Sequence
  sgRNA
  Tmem204_7
gatgcgtgcctgcaacctgg

SEQ ID NO: 61407 - DNA, 20 bp, Artificial Sequence
  sgRNA
  Tmem204_8
ctcactgcacggtttcgccg

SEQ ID NO: 61408 - DNA, 20 bp, Artificial Sequence
  sgRNA
  Tmem204_9
cctgcccagttcgagtccca

SEQ ID NO: 61409 - DNA, 20 bp, Artificial Sequence
  sgRNA
  Tmem204_10
tcagccgttctctcactgca

SEQ ID NO: 61410 - DNA, 20 bp, Artificial Sequence
  sgRNA
  Tmem204_11
agatgagcattgcagccgcc

SEQ ID NO: 61411 - DNA, 20 bp, Artificial Sequence
  sgRNA
  Tmem204_12
ctggaacattcttcaccgga

SEQ ID NO: 61412 - DNA, 20 bp, Artificial Sequence
  sgRNA
  Tmem204_13
tggtcttgctacctgaacat

SEQ ID NO: 61413 - DNA, 20 bp, Artificial Sequence
  sgRNA
  Tmem204_14
acggctgatgacgatcaccc

SEQ ID NO: 61414 - DNA, 20 bp, Artificial Sequence
  sgRNA
  Tmem204_15
ggatggggctcggaatcagc

SEQ ID NO: 61415 - DNA, 20 bp, Artificial Sequence
  sgRNA
  Tmem204_16
gatgagcattgcagccgcca

SEQ ID NO: 61416 - DNA, 20 bp, Artificial Sequence
  sgRNA
  Tmem204_17
gcgtctggtacacccaattg

SEQ ID NO: 61417 - DNA, 20 bp, Artificial Sequence
  sgRNA
  Tmem204_18
cagcagccttcacccccaat

SEQ ID NO: 61418 - DNA, 20 bp, Artificial Sequence
  sgRNA
  Tmem204_19
ggtaagggagtcacaagccc

SEQ ID NO: 61419 - DNA, 20 bp, Artificial Sequence
  sgRNA
  Tmem204_20
catgatgcgtgcctgcaacc

SEQ ID NO: 61420 - DNA, 20 bp, Artificial Sequence
  sgRNA
  Tmem211_1
cctggcaaacaaccttcggg

SEQ ID NO: 61421 - DNA, 20 bp, Artificial Sequence
  sgRNA
  Tmem211_2
tcagctgcaacacttctggg

SEQ ID NO: 61422 - DNA, 20 bp, Artificial Sequence
  sgRNA
  Tmem211_3
gacgggctttggtccgacac

SEQ ID NO: 61423 - DNA, 20 bp, Artificial Sequence
  sgRNA
  Tmem211_4
gtaggtaaagataccataag

SEQ ID NO: 61424 - DNA, 20 bp, Artificial Sequence
  sgRNA
  Tmem211_5
ggctcctccatgtaccacag

SEQ ID NO: 61425 - DNA, 20 bp, Artificial Sequence
  sgRNA
  Tmem211_6
tgtaccacagcggagcatgc

SEQ ID NO: 61426 - DNA, 20 bp, Artificial Sequence
  sgRNA
  Tmem211_7
aaggctctggaaccaggcgg

SEQ ID NO: 61427 - DNA, 20 bp, Artificial Sequence
  sgRNA
  Tmem211_8
tgccactgctatcctcaaca

SEQ ID NO: 61428 - DNA, 20 bp, Artificial Sequence
  sgRNA
  Tmem211_9
gaccatgttgaggatagcag

SEQ ID NO: 61429 - DNA, 20 bp, Artificial Sequence
  sgRNA
  Tmem211_10
ggtaaagataccataagagg

SEQ ID NO: 61430 - DNA, 20 bp, Artificial Sequence
  sgRNA
  Tmem211_11
ccacctgatgacaagcaggc

SEQ ID NO: 61431 - DNA, 20 bp, Artificial Sequence
  sgRNA
  Tmem211_12
gctctgggactctctctcac

SEQ ID NO: 61432 - DNA, 20 bp, Artificial Sequence
  sgRNA
  Tmem211_13
aaaggctctggaaccaggcg

SEQ ID NO: 61433 - DNA, 20 bp, Artificial Sequence
  sgRNA
  Tmem211_14
tccgacaccggtggtgcagg

SEQ ID NO: 61434 - DNA, 20 bp, Artificial Sequence
  sgRNA
  Tmem211_15
tgctccgctgtggtacatgg

SEQ ID NO: 61435 - DNA, 20 bp, Artificial Sequence
  sgRNA
  Tmem211_16
ggagcatgccggctgagctg

SEQ ID NO: 61436 - DNA, 20 bp, Artificial Sequence
  sgRNA
  Tmem211_17
ccagcctgcttgtcatcagg

SEQ ID NO: 61437 - DNA, 20 bp, Artificial Sequence
  sgRNA
  Tmem211_18
gtcctggcaaacaaccttcg

SEQ ID NO: 61438 - DNA, 20 bp, Artificial Sequence
  sgRNA
  Tmem211_19
tggttccagcagtcacctgg

SEQ ID NO: 61439 - DNA, 20 bp, Artificial Sequence
  sgRNA
  Tmem211_20
ctttggttccagcagtcacc

SEQ ID NO: 61440 - DNA, 20 bp, Artificial Sequence
  sgRNA
  Tmem213_1
cggcaacacagggaggctag

SEQ ID NO: 61441 - DNA, 20 bp, Artificial Sequence
  sgRNA
  Tmem213_2
tgtaccgcaggataagtgga

SEQ ID NO: 61442 - DNA, 20 bp, Artificial Sequence
  sgRNA
  Tmem213_3
agggcacctctgcagcaaca

SEQ ID NO: 61443 - DNA, 20 bp, Artificial Sequence
  sgRNA
  Tmem213_4
tgaggtgcccagggtttcgg

SEQ ID NO: 61444 - DNA, 20 bp, Artificial Sequence
  sgRNA
  Tmem213_5
atatggctggattgcggcag

SEQ ID NO: 61445 - DNA, 20 bp, Artificial Sequence
  sgRNA
  Tmem213_6
agatgaatatggctggattg

SEQ ID NO: 61446 - DNA, 20 bp, Artificial Sequence
  sgRNA
  Tmem213_7
aatccagccatattcatcta

SEQ ID NO: 61447 - DNA, 20 bp, Artificial Sequence
  sgRNA
  Tmem213_8
ggaagcccggcaacacaggg

SEQ ID NO: 61448 - DNA, 20 bp, Artificial Sequence
  sgRNA
  Tmem213_9
gttgctgcagaggtgccctg

SEQ ID NO: 61449 - DNA, 20 bp, Artificial Sequence
  sgRNA
  Tmem213_10
acctccttccacttatcctg

SEQ ID NO: 61450 - DNA, 20 bp, Artificial Sequence
  sgRNA
  Tmem213_11
gaccaggctgaagaggaggg

SEQ ID NO: 61451 - DNA, 20 bp, Artificial Sequence
  sgRNA
  Tmem213_12
gtccacgcacagcaggatga

SEQ ID NO: 61452 - DNA, 20 bp, Artificial Sequence
  sgRNA
  Tmem213_13
agtgcacaccacccagaccc

SEQ ID NO: 61453 - DNA, 20 bp, Artificial Sequence
  sgRNA
  Tmem213_14
ggcaacacagggaggctagt

SEQ ID NO: 61454 - DNA, 20 bp, Artificial Sequence
  sgRNA
  Tmem213_15
gtgtcttcctccgaaaccct

SEQ ID NO: 61455 - DNA, 20 bp, Artificial Sequence
  sgRNA
  Tmem213_16
gtgcacaccacccagacccc

SEQ ID NO: 61456 - DNA, 20 bp, Artificial Sequence
  sgRNA
  Tmem213_17
cacactgctccagggtcccg

SEQ ID NO: 61457 - DNA, 20 bp, Artificial Sequence
  sgRNA
  Tmem213_18
catattcatctacggaagcc

SEQ ID NO: 61458 - DNA, 20 bp, Artificial Sequence
  sgRNA
  Tmem213_19
tacggaagcccggcaacaca

SEQ ID NO: 61459 - DNA, 20 bp, Artificial Sequence
  sgRNA
  Tmem213_20
actgggccatgttgctgcag

SEQ ID NO: 61460 - DNA, 20 bp, Artificial Sequence
  sgRNA
  Tmem217_1
cctcaccgacgagttcagtg

SEQ ID NO: 61461 - DNA, 20 bp, Artificial Sequence
  sgRNA
  Tmem217_2
gtgtatgcccagatatacga

SEQ ID NO: 61462 - DNA, 20 bp, Artificial Sequence
  sgRNA
  Tmem217_3
ctcagggcctcaacatactg

SEQ ID NO: 61463 - DNA, 20 bp, Artificial Sequence
  sgRNA
  Tmem217_4
tgtgggttgacagccaggat

SEQ ID NO: 61464 - DNA, 20 bp, Artificial Sequence
  sgRNA
  Tmem217_5
ataatctttgatttccgccg

SEQ ID NO: 61465 - DNA, 20 bp, Artificial Sequence
  sgRNA
  Tmem217_6
ccctggtcagagccatgcga

SEQ ID NO: 61466 - DNA, 20 bp, Artificial Sequence
  sgRNA
  Tmem217_7
gaagcggagaccgtccacgg

SEQ ID NO: 61467 - DNA, 20 bp, Artificial Sequence
  sgRNA
  Tmem217_8
gggcatacacagagtacagg

SEQ ID NO: 61468 - DNA, 20 bp, Artificial Sequence
  sgRNA
  Tmem217_9
tcttgggaacggcaactgca

SEQ ID NO: 61469 - DNA, 20 bp, Artificial Sequence
  sgRNA
  Tmem217_10
tgaaagttcctactccccgg

SEQ ID NO: 61470 - DNA, 20 bp, Artificial Sequence
  sgRNA
  Tmem217_11
tgtgtatgcccagatatacg

SEQ ID NO: 61471 - DNA, 20 bp, Artificial Sequence
  sgRNA
  Tmem217_12
tggtgatgatggacgtgaag

SEQ ID NO: 61472 - DNA, 20 bp, Artificial Sequence
  sgRNA
  Tmem217_13
cacccagccgaaccatcgca

SEQ ID NO: 61473 - DNA, 20 bp, Artificial Sequence
  sgRNA
  Tmem217_14
tgggaagcggagaccgtcca

SEQ ID NO: 61474 - DNA, 20 bp, Artificial Sequence
  sgRNA
  Tmem217_15
ggctgaaagttcctactccc

SEQ ID NO: 61475 - DNA, 20 bp, Artificial Sequence
  sgRNA
  Tmem217_16
tctttgatttccgccgtgga

SEQ ID NO: 61476 - DNA, 20 bp, Artificial Sequence
  sgRNA
  Tmem217_17
gagccatgcgatggttcggc

SEQ ID NO: 61477 - DNA, 20 bp, Artificial Sequence
  sgRNA
  Tmem217_18
agaagtacctcagtatgttg

SEQ ID NO: 61478 - DNA, 20 bp, Artificial Sequence
  sgRNA
  Tmem217_19
gtatgttgaggccctgagcc

SEQ ID NO: 61479 - DNA, 20 bp, Artificial Sequence
  sgRNA
  Tmem217_20
ttcaaagatgaggtgcatgt

SEQ ID NO: 61480 - DNA, 20 bp, Artificial Sequence
  sgRNA
  Tmem219_1
aaggagcagcaggatcaaag

SEQ ID NO: 61481 - DNA, 20 bp, Artificial Sequence
  sgRNA
  Tmem219_2
ggatataggtggttggctag

SEQ ID NO: 61482 - DNA, 20 bp, Artificial Sequence
  sgRNA
  Tmem219_3
ccatgaatgagacagtcaca

SEQ ID NO: 61483 - DNA, 20 bp, Artificial Sequence
  sgRNA
  Tmem219_4
gcaccccgggtacttacctg

SEQ ID NO: 61484 - DNA, 20 bp, Artificial Sequence
  sgRNA
  Tmem219_5
agttccactggtctagaaca

SEQ ID NO: 61485 - DNA, 20 bp, Artificial Sequence
  sgRNA
  Tmem219_6
tcctctgagcaggatatagg

SEQ ID NO: 61486 - DNA, 20 bp, Artificial Sequence
  sgRNA
  Tmem219_7
aagtggcacagaccaaaggt

SEQ ID NO: 61487 - DNA, 20 bp, Artificial Sequence
  sgRNA
  Tmem219_8
agactgcagtggtacagcag

SEQ ID NO: 61488 - DNA, 20 bp, Artificial Sequence
  sgRNA
  Tmem219_9
cagacccctctgctccccat

SEQ ID NO: 61489 - DNA, 20 bp, Artificial Sequence
  sgRNA
  Tmem219_10
ggtcttctaaactcagaagt

SEQ ID NO: 61490 - DNA, 20 bp, Artificial Sequence
  sgRNA
  Tmem219_11
gctaccctgagcccagtgat

SEQ ID NO: 61491 - DNA, 20 bp, Artificial Sequence
  sgRNA
  Tmem219_12
gtcctccagcaggcacccca

SEQ ID NO: 61492 - DNA, 20 bp, Artificial Sequence
  sgRNA
  Tmem219_13
tggcgtcaggaaggactcca

SEQ ID NO: 61493 - DNA, 20 bp, Artificial Sequence
  sgRNA
  Tmem219_14
gaccagtggaactctgggcg

SEQ ID NO: 61494 - DNA, 20 bp, Artificial Sequence
  sgRNA
  Tmem219_15
ccgtagccctgacattcccc

SEQ ID NO: 61495 - DNA, 20 bp, Artificial Sequence
  sgRNA
  Tmem219_16
gctccccatgggcagctgcc

SEQ ID NO: 61496 - DNA, 20 bp, Artificial Sequence
  sgRNA
  Tmem219_17
cctatatcctgctcagagga

SEQ ID NO: 61497 - DNA, 20 bp, Artificial Sequence
  sgRNA
  Tmem219_18
tgcctgctggaggacagtaa

SEQ ID NO: 61498 - DNA, 20 bp, Artificial Sequence
  sgRNA
  Tmem219_19
actttgatcctgctgctcct

SEQ ID NO: 61499 - DNA, 20 bp, Artificial Sequence
  sgRNA
  Tmem219_20
atgagacagtcacagggacg

SEQ ID NO: 61500 - DNA, 20 bp, Artificial Sequence
  sgRNA
  Tmem225_1
gttgatagtaggactcatca

SEQ ID NO: 61501 - DNA, 20 bp, Artificial Sequence
  sgRNA
  Tmem225_2
tgaccttcgggccaaaaagg

SEQ ID NO: 61502 - DNA, 20 bp, Artificial Sequence
  sgRNA
  Tmem225_3
aggtggtcaggcggataatg

SEQ ID NO: 61503 - DNA, 20 bp, Artificial Sequence
  sgRNA
  Tmem225_4
tcgttaattacaagaccaag

SEQ ID NO: 61504 - DNA, 20 bp, Artificial Sequence
  sgRNA
  Tmem225_5
cgaggcattgcacatcgtgg

SEQ ID NO: 61505 - DNA, 20 bp, Artificial Sequence
  sgRNA
  Tmem225_6
ttatccgcctgaccacctcc

SEQ ID NO: 61506 - DNA, 20 bp, Artificial Sequence
  sgRNA
  Tmem225_7
tgtgcactctgtgacctcaa

SEQ ID NO: 61507 - DNA, 20 bp, Artificial Sequence
  sgRNA
  Tmem225_8
ttgaggtcacagagtgcaca

SEQ ID NO: 61508 - DNA, 20 bp, Artificial Sequence
  sgRNA
  Tmem225_9
gaaacaacttcgattgtact

SEQ ID NO: 61509 - DNA, 20 bp, Artificial Sequence
  sgRNA
  Tmem225_10
ataaaactactcacagtcca

SEQ ID NO: 61510 - DNA, 20 bp, Artificial Sequence
  sgRNA
  Tmem225_11
gaccacacacccaagcacgt

SEQ ID NO: 61511 - DNA, 20 bp, Artificial Sequence
  sgRNA
  Tmem225_12
atcgccctctttcttacctg

SEQ ID NO: 61512 - DNA, 20 bp, Artificial Sequence
  sgRNA
  Tmem225_13
gacagtgaaagctatccact

SEQ ID NO: 61513 - DNA, 20 bp, Artificial Sequence
  sgRNA
  Tmem225_14
ccaggttacccgacgtgctt

SEQ ID NO: 61514 - DNA, 20 bp, Artificial Sequence
  sgRNA
  Tmem225_15
actcatcatggaagactggg

SEQ ID NO: 61515 - DNA, 20 bp, Artificial Sequence
  sgRNA
  Tmem225_16
cttcgaggcattgcacatcg

SEQ ID NO: 61516 - DNA, 20 bp, Artificial Sequence
  sgRNA
  Tmem225_17
ccaagcacgtcgggtaacct

SEQ ID NO: 61517 - DNA, 20 bp, Artificial Sequence
  sgRNA
  Tmem225_18
gccaacatattcttctcctc

SEQ ID NO: 61518 - DNA, 20 bp, Artificial Sequence
  sgRNA
  Tmem225_19
atctatctaaacttgatcat

SEQ ID NO: 61519 - DNA, 20 bp, Artificial Sequence
  sgRNA
  Tmem225_20
ggaggacagcatcccagcca

SEQ ID NO: 61520 - DNA, 20 bp, Artificial Sequence
  sgRNA
  Tmem231_1
gctgaagcggagcagctacg

SEQ ID NO: 61521 - DNA, 20 bp, Artificial Sequence
  sgRNA
  Tmem231_2
ccgacacgagcgggacgcgc

SEQ ID NO: 61522 - DNA, 20 bp, Artificial Sequence
  sgRNA
  Tmem231_3
ggtcaacagcaggaagagcg

SEQ ID NO: 61523 - DNA, 20 bp, Artificial Sequence
  sgRNA
  Tmem231_4
gaacgtgctccaggcgagga

SEQ ID NO: 61524 - DNA, 20 bp, Artificial Sequence
  sgRNA
  Tmem231_5
aatcgagcgcgcttaccgcg

SEQ ID NO: 61525 - DNA, 20 bp, Artificial Sequence
  sgRNA
  Tmem231_6
tcaggattagctgcacaccg

SEQ ID NO: 61526 - DNA, 20 bp, Artificial Sequence
  sgRNA
  Tmem231_7
tcacatataactgtgaccca

SEQ ID NO: 61527 - DNA, 20 bp, Artificial Sequence
  sgRNA
  Tmem231_8
tatatgtgaatggcgacctg

SEQ ID NO: 61528 - DNA, 20 bp, Artificial Sequence
  sgRNA
  Tmem231_9
tgctgtcatccgctatccca

SEQ ID NO: 61529 - DNA, 20 bp, Artificial Sequence
  sgRNA
  Tmem231_10
gggagatgatcaagttcgcc

SEQ ID NO: 61530 - DNA, 20 bp, Artificial Sequence
  sgRNA
  Tmem231_11
agtcctcctttgctgtccct

SEQ ID NO: 61531 - DNA, 20 bp, Artificial Sequence
  sgRNA
  Tmem231_12
atgacagcatggatcacgaa

SEQ ID NO: 61532 - DNA, 20 bp, Artificial Sequence
  sgRNA
  Tmem231_13
tgattctttcaaacacccag

SEQ ID NO: 61533 - DNA, 20 bp, Artificial Sequence
  sgRNA
  Tmem231_14
tgtatctgatgtccaggcca

SEQ ID NO: 61534 - DNA, 20 bp, Artificial Sequence
  sgRNA
  Tmem231_15
aagcagccactgagctaccg

SEQ ID NO: 61535 - DNA, 20 bp, Artificial Sequence
  sgRNA
  Tmem231_16
tctttccgtatctctccctg

SEQ ID NO: 61536 - DNA, 20 bp, Artificial Sequence
  sgRNA
  Tmem231_17
gggtcacagttatatgtgaa

SEQ ID NO: 61537 - DNA, 20 bp, Artificial Sequence
  sgRNA
  Tmem231_18
catcctgctgatcttcctct

SEQ ID NO: 61538 - DNA, 20 bp, Artificial Sequence
  sgRNA
  Tmem231_19
cccaccttcaaccggctgca

SEQ ID NO: 61539 - DNA, 20 bp, Artificial Sequence
  sgRNA
  Tmem231_20
atccctgtagccgtgcccca

SEQ ID NO: 61540 - DNA, 20 bp, Artificial Sequence
  sgRNA
  Tmem235_1
agacccaaccacatacgatg

SEQ ID NO: 61541 - DNA, 20 bp, Artificial Sequence
  sgRNA
  Tmem235_2
agaagagctgcacgccaccg

SEQ ID NO: 61542 - DNA, 20 bp, Artificial Sequence
  sgRNA
  Tmem235_3
ctggcaaatgggtcaatcag

SEQ ID NO: 61543 - DNA, 20 bp, Artificial Sequence
  sgRNA
  Tmem235_4
gaagctgagtaaggcgccca

SEQ ID NO: 61544 - DNA, 20 bp, Artificial Sequence
  sgRNA
  Tmem235_5
cgactactggtacatcctgg

SEQ ID NO: 61545 - DNA, 20 bp, Artificial Sequence
  sgRNA
  Tmem235_6
ggctgctacttcttgctagg

SEQ ID NO: 61546 - DNA, 20 bp, Artificial Sequence
  sgRNA
  Tmem235_7
cagcttcgcgctgctggcag

SEQ ID NO: 61547 - DNA, 20 bp, Artificial Sequence
  sgRNA
  Tmem235_8
gtagatgctgagccctgcca

SEQ ID NO: 61548 - DNA, 20 bp, Artificial Sequence
  sgRNA
  Tmem235_9
acgtgcacatcagcttcggc

SEQ ID NO: 61549 - DNA, 20 bp, Artificial Sequence
  sgRNA
  Tmem235_10
ctcacacctggcattcgtgg

SEQ ID NO: 61550 - DNA, 20 bp, Artificial Sequence
  sgRNA
  Tmem235_11
tgcgcctcggaggtgctcag

SEQ ID NO: 61551 - DNA, 20 bp, Artificial Sequence
  sgRNA
  Tmem235_12
gggccgcctccacgaatgcc

SEQ ID NO: 61552 - DNA, 20 bp, Artificial Sequence
  sgRNA
  Tmem235_13
cgtgcgtcacgccgtacgtg

SEQ ID NO: 61553 - DNA, 20 bp, Artificial Sequence
  sgRNA
  Tmem235_14
attgacccatttgccagtgc

SEQ ID NO: 61554 - DNA, 20 bp, Artificial Sequence
  sgRNA
  Tmem235_15
acacctggcattcgtggagg

SEQ ID NO: 61555 - DNA, 20 bp, Artificial Sequence
  sgRNA
  Tmem235_16
aaccacatacgatgaggacg

SEQ ID NO: 61556 - DNA, 20 bp, Artificial Sequence
  sgRNA
  Tmem235_17
caggatgtaccagtagtcgc

SEQ ID NO: 61557 - DNA, 20 bp, Artificial Sequence
  sgRNA
  Tmem235_18
ggagggagaaacttccaggc

SEQ ID NO: 61558 - DNA, 20 bp, Artificial Sequence
  sgRNA
  Tmem235_19
ctacatcagctactcacacc

SEQ ID NO: 61559 - DNA, 20 bp, Artificial Sequence
  sgRNA
  Tmem235_20
cgaagctgagtaaggcgccc

SEQ ID NO: 61560 - DNA, 20 bp, Artificial Sequence
  sgRNA
  Tmem245_1
ccgtagtcggcgaagcagag

SEQ ID NO: 61561 - DNA, 20 bp, Artificial Sequence
  sgRNA
  Tmem245_2
gctcgtgtacttcatcctcg

SEQ ID NO: 61562 - DNA, 20 bp, Artificial Sequence
  sgRNA
  Tmem245_3
ccaagcccgataatcggcca

SEQ ID NO: 61563 - DNA, 20 bp, Artificial Sequence
  sgRNA
  Tmem245_4
agaacgtgacacactctgga

SEQ ID NO: 61564 - DNA, 20 bp, Artificial Sequence
  sgRNA
  Tmem245_5
tgtcagccacaggtctagaa

SEQ ID NO: 61565 - DNA, 20 bp, Artificial Sequence
  sgRNA
  Tmem245_6
ctacctgaccggcttagcag

SEQ ID NO: 61566 - DNA, 20 bp, Artificial Sequence
  sgRNA
  Tmem245_7
gatgaagtacacgagcaccg

SEQ ID NO: 61567 - DNA, 20 bp, Artificial Sequence
  sgRNA
  Tmem245_8
ctgctaagccggtcaggtag

SEQ ID NO: 61568 - DNA, 20 bp, Artificial Sequence
  sgRNA
  Tmem245_9
gcttctatggactgtacacc

SEQ ID NO: 61569 - DNA, 20 bp, Artificial Sequence
  sgRNA
  Tmem245_10
cgcgtgagcgagctcttgaa

SEQ ID NO: 61570 - DNA, 20 bp, Artificial Sequence
  sgRNA
  Tmem245_11
gctggactcatacccagtga

SEQ ID NO: 61571 - DNA, 20 bp, Artificial Sequence
  sgRNA
  Tmem245_12
agtggaatgcaagcactcaa

SEQ ID NO: 61572 - DNA, 20 bp, Artificial Sequence
  sgRNA
  Tmem245_13
ggtgtgggcatcgagttcgt

SEQ ID NO: 61573 - DNA, 20 bp, Artificial Sequence
  sgRNA
  Tmem245_14
tcatcctcgaggccttcctg

SEQ ID NO: 61574 - DNA, 20 bp, Artificial Sequence
  sgRNA
  Tmem245_15
ctgcttcgccgactacggcg

SEQ ID NO: 61575 - DNA, 20 bp, Artificial Sequence
  sgRNA
  Tmem245_16
tgattgctccttctaggccc

SEQ ID NO: 61576 - DNA, 20 bp, Artificial Sequence
  sgRNA
  Tmem245_17
gttcgatgcttccctcaaaa

SEQ ID NO: 61577 - DNA, 20 bp, Artificial Sequence
  sgRNA
  Tmem245_18
gctgagtctgagcaggccaa

SEQ ID NO: 61578 - DNA, 20 bp, Artificial Sequence
  sgRNA
  Tmem245_19
aagagctcgctcacgcgcct

SEQ ID NO: 61579 - DNA, 20 bp, Artificial Sequence
  sgRNA
  Tmem245_20
gcctagaaggagcaatcatt

SEQ ID NO: 61580 - DNA, 20 bp, Artificial Sequence
  sgRNA
  Tmem25_1
tccaggtaccaggctaatcg

SEQ ID NO: 61581 - DNA, 20 bp, Artificial Sequence
  sgRNA
  Tmem25_2
gcaaattgatggtcagacct

SEQ ID NO: 61582 - DNA, 20 bp, Artificial Sequence
  sgRNA
  Tmem25_3
cttggcacacaacctctcgg

SEQ ID NO: 61583 - DNA, 20 bp, Artificial Sequence
  sgRNA
  Tmem25_4
cagtggcacttctatccgtg

SEQ ID NO: 61584 - DNA, 20 bp, Artificial Sequence
  sgRNA
  Tmem25_5
tatcagagaaggacgccggg

SEQ ID NO: 61585 - DNA, 20 bp, Artificial Sequence
  sgRNA
  Tmem25_6
cattggtggccaccaccgag

SEQ ID NO: 61586 - DNA, 20 bp, Artificial Sequence
  sgRNA
  Tmem25_7
gagcagcagtgtgtgccgga

SEQ ID NO: 61587 - DNA, 20 bp, Artificial Sequence
  sgRNA
  Tmem25_8
gtggtggccaccaatgacgt

SEQ ID NO: 61588 - DNA, 20 bp, Artificial Sequence
  sgRNA
  Tmem25_9
cggtagatgtagcccaacat

SEQ ID NO: 61589 - DNA, 20 bp, Artificial Sequence
  sgRNA
  Tmem25_10
agaacctcctgcaacccgac

SEQ ID NO: 61590 - DNA, 20 bp, Artificial Sequence
  sgRNA
  Tmem25_11
ggtggtggccaccaatgacg

SEQ ID NO: 61591 - DNA, 20 bp, Artificial Sequence
  sgRNA
  Tmem25_12
gccacaacgatgcccagcag

SEQ ID NO: 61592 - DNA, 20 bp, Artificial Sequence
  sgRNA
  Tmem25_13
gtaccaggctaatcggggag

SEQ ID NO: 61593 - DNA, 20 bp, Artificial Sequence
  sgRNA
  Tmem25_14
gggcaaacaggacaaccaga

SEQ ID NO: 61594 - DNA, 20 bp, Artificial Sequence
  sgRNA
  Tmem25_15
gagctggcgccgcaaattga

SEQ ID NO: 61595 - DNA, 20 bp, Artificial Sequence
  sgRNA
  Tmem25_16
agatatcagagaaggacgcc

SEQ ID NO: 61596 - DNA, 20 bp, Artificial Sequence
  sgRNA
  Tmem25_17
actgctccctgcaggaccca

SEQ ID NO: 61597 - DNA, 20 bp, Artificial Sequence
  sgRNA
  Tmem25_18
tcacctggattgaccaggat

SEQ ID NO: 61598 - DNA, 20 bp, Artificial Sequence
  sgRNA
  Tmem25_19
gaggtcattgagctgaaggt

SEQ ID NO: 61599 - DNA, 20 bp, Artificial Sequence
  sgRNA
  Tmem25_20
gaacacagcaggcagccgct

SEQ ID NO: 61600 - DNA, 20 bp, Artificial Sequence
  sgRNA
  Tmem255a_1
ccaaaattactccttctacg

SEQ ID NO: 61601 - DNA, 20 bp, Artificial Sequence
  sgRNA
  Tmem255a_2
tggcaccggttagcatagag

SEQ ID NO: 61602 - DNA, 20 bp, Artificial Sequence
  sgRNA
  Tmem255a_3
agcagggtggaaatcaccgg

SEQ ID NO: 61603 - DNA, 20 bp, Artificial Sequence
  sgRNA
  Tmem255a_4
aactgccctcaacttagccg

SEQ ID NO: 61604 - DNA, 20 bp, Artificial Sequence
  sgRNA
  Tmem255a_5
ttactatgcgcgtccccaag

SEQ ID NO: 61605 - DNA, 20 bp, Artificial Sequence
  sgRNA
  Tmem255a_6
tgttcccaagacatcacaga

SEQ ID NO: 61606 - DNA, 20 bp, Artificial Sequence
  sgRNA
  Tmem255a_7
aatgtactcatagtagccgc

SEQ ID NO: 61607 - DNA, 20 bp, Artificial Sequence
  sgRNA
  Tmem255a_8
agttcagtgccggaagagta

SEQ ID NO: 61608 - DNA, 20 bp, Artificial Sequence
  sgRNA
  Tmem255a_9
tcctgggtaataacctccca

SEQ ID NO: 61609 - DNA, 20 bp, Artificial Sequence
  sgRNA
  Tmem255a_10
gcccaccgtgagaattaaca

SEQ ID NO: 61610 - DNA, 20 bp, Artificial Sequence
  sgRNA
  Tmem255a_11
aagtcataagcagaatacgg

SEQ ID NO: 61611 - DNA, 20 bp, Artificial Sequence
  sgRNA
  Tmem255a_12
tgctcatcggagagtccaga

SEQ ID NO: 61612 - DNA, 20 bp, Artificial Sequence
  sgRNA
  Tmem255a_13
tcaacagagcagttcagtgc

SEQ ID NO: 61613 - DNA, 20 bp, Artificial Sequence
  sgRNA
  Tmem255a_14
gctggaccgctgctgagtca

SEQ ID NO: 61614 - DNA, 20 bp, Artificial Sequence
  sgRNA
  Tmem255a_15
gccaccatcctcaacatcgt

SEQ ID NO: 61615 - DNA, 20 bp, Artificial Sequence
  sgRNA
  Tmem255a_16
ggctttgaggaaccttaccc

SEQ ID NO: 61616 - DNA, 20 bp, Artificial Sequence
  sgRNA
  Tmem255a_17
accagagtaggtggtacagg

SEQ ID NO: 61617 - DNA, 20 bp, Artificial Sequence
  sgRNA
  Tmem255a_18
caggtgttgccccggatgcg

SEQ ID NO: 61618 - DNA, 20 bp, Artificial Sequence
  sgRNA
  Tmem255a_19
ggtttgacccgatgatccca

SEQ ID NO: 61619 - DNA, 20 bp, Artificial Sequence
  sgRNA
  Tmem255a_20
tgaaaccactctatgctaac

SEQ ID NO: 61620 - DNA, 20 bp, Artificial Sequence
  sgRNA
  Tmem255b_1
gtatgacgtctatcagacag

SEQ ID NO: 61621 - DNA, 20 bp, Artificial Sequence
  sgRNA
  Tmem255b_2
tcgacagcgtgttcgcagcg

SEQ ID NO: 61622 - DNA, 20 bp, Artificial Sequence
  sgRNA
  Tmem255b_3
tcgtagagggctttgccagg

SEQ ID NO: 61623 - DNA, 20 bp, Artificial Sequence
  sgRNA
  Tmem255b_4
cacgcccacaaactcatagt

SEQ ID NO: 61624 - DNA, 20 bp, Artificial Sequence
  sgRNA
  Tmem255b_5
gttggcacacccatagacgg

SEQ ID NO: 61625 - DNA, 20 bp, Artificial Sequence
  sgRNA
  Tmem255b_6
gctgcgacctctacgcctgt

SEQ ID NO: 61626 - DNA, 20 bp, Artificial Sequence
  sgRNA
  Tmem255b_7
tgtcacagctgcagtcctag

SEQ ID NO: 61627 - DNA, 20 bp, Artificial Sequence
  sgRNA
  Tmem255b_8
ccgccaccaccccaaagctg

SEQ ID NO: 61628 - DNA, 20 bp, Artificial Sequence
  sgRNA
  Tmem255b_9
gcatgggaacacccacggct

SEQ ID NO: 61629 - DNA, 20 bp, Artificial Sequence
  sgRNA
  Tmem255b_10
tgttgctcctcaccttcaac

SEQ ID NO: 61630 - DNA, 20 bp, Artificial Sequence
  sgRNA
  Tmem255b_11
ttggccttgctgcaaccacc

SEQ ID NO: 61631 - DNA, 20 bp, Artificial Sequence
  sgRNA
  Tmem255b_12
tctactctcatcctgaccat

SEQ ID NO: 61632 - DNA, 20 bp, Artificial Sequence
  sgRNA
  Tmem255b_13
aactcatagtaggcaggcga

SEQ ID NO: 61633 - DNA, 20 bp, Artificial Sequence
  sgRNA
  Tmem255b_14
ctgtggatacccagagcagc

SEQ ID NO: 61634 - DNA, 20 bp, Artificial Sequence
  sgRNA
  Tmem255b_15
ttatagagaatctgaggtgg

SEQ ID NO: 61635 - DNA, 20 bp, Artificial Sequence
  sgRNA
  Tmem255b_16
gcagggttatagagaatctg

SEQ ID NO: 61636 - DNA, 20 bp, Artificial Sequence
  sgRNA
  Tmem255b_17
gcccaatacgttcagcactg

SEQ ID NO: 61637 - DNA, 20 bp, Artificial Sequence
  sgRNA
  Tmem255b_18
ggatgagagtagacaccagc

SEQ ID NO: 61638 - DNA, 20 bp, Artificial Sequence
  sgRNA
  Tmem255b_19
atacaagtacccagccccac

SEQ ID NO: 61639 - DNA, 20 bp, Artificial Sequence
  sgRNA
  Tmem255b_20
ctgtgggcggctactaccca

SEQ ID NO: 61640 - DNA, 20 bp, Artificial Sequence
  sgRNA
  Tmem26_1
ctcaccctcaagttcaagcg

SEQ ID NO: 61641 - DNA, 20 bp, Artificial Sequence
  sgRNA
  Tmem26_2
taatattaatcattggacgg

SEQ ID NO: 61642 - DNA, 20 bp, Artificial Sequence
  sgRNA
  Tmem26_3
ccagaccggttcacatacca

SEQ ID NO: 61643 - DNA, 20 bp, Artificial Sequence
  sgRNA
  Tmem26_4
gtgcatttcaagaagccaca

SEQ ID NO: 61644 - DNA, 20 bp, Artificial Sequence
  sgRNA
  Tmem26_5
ctagtgatggtgcctccaat

SEQ ID NO: 61645 - DNA, 20 bp, Artificial Sequence
  sgRNA
  Tmem26_6
gtgacaggtgaggttcgcaa

SEQ ID NO: 61646 - DNA, 20 bp, Artificial Sequence
  sgRNA
  Tmem26_7
cgtcgggtaagactcctcgg

SEQ ID NO: 61647 - DNA, 20 bp, Artificial Sequence
  sgRNA
  Tmem26_8
tcgtccgcgcttgaacttga

SEQ ID NO: 61648 - DNA, 20 bp, Artificial Sequence
  sgRNA
  Tmem26_9
tcaacatcatgccgtccctg

SEQ ID NO: 61649 - DNA, 20 bp, Artificial Sequence
  sgRNA
  Tmem26_10
cacccaggtcactctccaga

SEQ ID NO: 61650 - DNA, 20 bp, Artificial Sequence
  sgRNA
  Tmem26_11
ccataatcaaagccacaagt

SEQ ID NO: 61651 - DNA, 20 bp, Artificial Sequence
  sgRNA
  Tmem26_12
gcagggccagcagccagtaa

SEQ ID NO: 61652 - DNA, 20 bp, Artificial Sequence
  sgRNA
  Tmem26_13
tggctttgattatggccacg

SEQ ID NO: 61653 - DNA, 20 bp, Artificial Sequence
  sgRNA
  Tmem26_14
atctcgcatgaagtccctcg

SEQ ID NO: 61654 - DNA, 20 bp, Artificial Sequence
  sgRNA
  Tmem26_15
tcactgggaccactctcaga

SEQ ID NO: 61655 - DNA, 20 bp, Artificial Sequence
  sgRNA
  Tmem26_16
atgggaggatgcttccccgg

SEQ ID NO: 61656 - DNA, 20 bp, Artificial Sequence
  sgRNA
  Tmem26_17
ctcctgctaatattaatcat

SEQ ID NO: 61657 - DNA, 20 bp, Artificial Sequence
  sgRNA
  Tmem26_18
ctgtctccaggaccagcaag

SEQ ID NO: 61658 - DNA, 20 bp, Artificial Sequence
  sgRNA
  Tmem26_19
accaggtacacaaagatggc

SEQ ID NO: 61659 - DNA, 20 bp, Artificial Sequence
  sgRNA
  Tmem26_20
tttcctgtgccagtacagtg

SEQ ID NO: 61660 - DNA, 20 bp, Artificial Sequence
  sgRNA
  Tmem30a_1
gacagaccaattgcgccatg

SEQ ID NO: 61661 - DNA, 20 bp, Artificial Sequence
  sgRNA
  Tmem30a_2
caacaacatccgtgagatcg

SEQ ID NO: 61662 - DNA, 20 bp, Artificial Sequence
  sgRNA
  Tmem30a_3
tacttacaagcaaagcacta

SEQ ID NO: 61663 - DNA, 20 bp, Artificial Sequence
  sgRNA
  Tmem30a_4
caagcacaagatgtcacatt

SEQ ID NO: 61664 - DNA, 20 bp, Artificial Sequence
  sgRNA
  Tmem30a_5
ttacacccaacattaccagc

SEQ ID NO: 61665 - DNA, 20 bp, Artificial Sequence
  sgRNA
  Tmem30a_6
acacggccttcaaacagcaa

SEQ ID NO: 61666 - DNA, 20 bp, Artificial Sequence
  sgRNA
  Tmem30a_7
ctgttggcaatagcgccaca

SEQ ID NO: 61667 - DNA, 20 bp, Artificial Sequence
  sgRNA
  Tmem30a_8
gatctcacggatgttgttgg

SEQ ID NO: 61668 - DNA, 20 bp, Artificial Sequence
  sgRNA
  Tmem30a_9
gtgaaattcagaaatccacc

SEQ ID NO: 61669 - DNA, 20 bp, Artificial Sequence
  sgRNA
  Tmem30a_10
agttgtatcgtctcatagag

SEQ ID NO: 61670 - DNA, 20 bp, Artificial Sequence
  sgRNA
  Tmem30a_11
aggccgatgatgaagaaggt

SEQ ID NO: 61671 - DNA, 20 bp, Artificial Sequence
  sgRNA
  Tmem30a_12
cgatacaacttacgaaaagt

SEQ ID NO: 61672 - DNA, 20 bp, Artificial Sequence
  sgRNA
  Tmem30a_13
ggcctcatcttcatccccat

SEQ ID NO: 61673 - DNA, 20 bp, Artificial Sequence
  sgRNA
  Tmem30a_14
gcgaaggatgaggtggacgg

SEQ ID NO: 61674 - DNA, 20 bp, Artificial Sequence
  sgRNA
  Tmem30a_15
atagcgccacatggcgcaat

SEQ ID NO: 61675 - DNA, 20 bp, Artificial Sequence
  sgRNA
  Tmem30a_16
acgaagatgccgatgccgat

SEQ ID NO: 61676 - DNA, 20 bp, Artificial Sequence
  sgRNA
  Tmem30a_17
aacagcaacggctacccgcc

SEQ ID NO: 61677 - DNA, 20 bp, Artificial Sequence
  sgRNA
  Tmem30a_18
tggcagcccatcctcacggc

SEQ ID NO: 61678 - DNA, 20 bp, Artificial Sequence
  sgRNA
  Tmem30a_19
atcttcatccccatcggcat

SEQ ID NO: 61679 - DNA, 20 bp, Artificial Sequence
  sgRNA
  Tmem30a_20
actgccttatgccagtttac

SEQ ID NO: 61680 - DNA, 20 bp, Artificial Sequence
  sgRNA
  Tmem37_1
gactcaaagaaagaccggtg

SEQ ID NO: 61681 - DNA, 20 bp, Artificial Sequence
  sgRNA
  Tmem37_2
tgtccgctcacggcgcaagt

SEQ ID NO: 61682 - DNA, 20 bp, Artificial Sequence
  sgRNA
  Tmem37_3
catgggcctagcacgcagtg

SEQ ID NO: 61683 - DNA, 20 bp, Artificial Sequence
  sgRNA
  Tmem37_4
tcagacagtgtggttcactg

SEQ ID NO: 61684 - DNA, 20 bp, Artificial Sequence
  sgRNA
  Tmem37_5
gcggacatcttcacacacct

SEQ ID NO: 61685 - DNA, 20 bp, Artificial Sequence
  sgRNA
  Tmem37_6
accctggcttacagaaagcg

SEQ ID NO: 61686 - DNA, 20 bp, Artificial Sequence
  sgRNA
  Tmem37_7
agaggataaaggcaaccagg

SEQ ID NO: 61687 - DNA, 20 bp, Artificial Sequence
  sgRNA
  Tmem37_8
tcttcagtctccatctgcga

SEQ ID NO: 61688 - DNA, 20 bp, Artificial Sequence
  sgRNA
  Tmem37_9
acagaaagcgaggttatgat

SEQ ID NO: 61689 - DNA, 20 bp, Artificial Sequence
  sgRNA
  Tmem37_10
acctcgctttctgtaagcca

SEQ ID NO: 61690 - DNA, 20 bp, Artificial Sequence
  sgRNA
  Tmem37_11
cttaaggcccaacagcttgt

SEQ ID NO: 61691 - DNA, 20 bp, Artificial Sequence
  sgRNA
  Tmem37_12
ggactcaaagaaagaccggt

SEQ ID NO: 61692 - DNA, 20 bp, Artificial Sequence
  sgRNA
  Tmem37_13
ggttgatctgattcttgagc

SEQ ID NO: 61693 - DNA, 20 bp, Artificial Sequence
  sgRNA
  Tmem37_14
aggactcaaagaaagaccgg

SEQ ID NO: 61694 - DNA, 20 bp, Artificial Sequence
  sgRNA
  Tmem37_15
gaattcacaccagaacatca

SEQ ID NO: 61695 - DNA, 20 bp, Artificial Sequence
  sgRNA
  Tmem37_16
catcatcgtgtgcactgccc

SEQ ID NO: 61696 - DNA, 20 bp, Artificial Sequence
  sgRNA
  Tmem37_17
tggcccacttgcgccgtgag

SEQ ID NO: 61697 - DNA, 20 bp, Artificial Sequence
  sgRNA
  Tmem37_18
gtccctgctggagggtccca

SEQ ID NO: 61698 - DNA, 20 bp, Artificial Sequence
  sgRNA
  Tmem37_19
tgaagaaaggaccacagcca

SEQ ID NO: 61699 - DNA, 20 bp, Artificial Sequence
  sgRNA
  Tmem37_20
caaagagatgatcctccact

SEQ ID NO: 61700 - DNA, 20 bp, Artificial Sequence
  sgRNA
  Tmem62_1
gccaaaacaaaggaacactt

SEQ ID NO: 61701 - DNA, 20 bp, Artificial Sequence
  sgRNA
  Tmem62_2
tcagcccaccaagcgtatgg

SEQ ID NO: 61702 - DNA, 20 bp, Artificial Sequence
  sgRNA
  Tmem62_3
gaatggaagagcctttctag

SEQ ID NO: 61703 - DNA, 20 bp, Artificial Sequence
  sgRNA
  Tmem62_4
gaagccaacaacatcttctg

SEQ ID NO: 61704 - DNA, 20 bp, Artificial Sequence
  sgRNA
  Tmem62_5
attatctcaccaacaaacca

SEQ ID NO: 61705 - DNA, 20 bp, Artificial Sequence
  sgRNA
  Tmem62_6
acgccgctgccgaagcccag

SEQ ID NO: 61706 - DNA, 20 bp, Artificial Sequence
  sgRNA
  Tmem62_7
tgtacagtagaagtataagt

SEQ ID NO: 61707 - DNA, 20 bp, Artificial Sequence
  sgRNA
  Tmem62_8
cattactgtccggatccctg

SEQ ID NO: 61708 - DNA, 20 bp, Artificial Sequence
  sgRNA
  Tmem62_9
ctatcatgtctccatcccca

SEQ ID NO: 61709 - DNA, 20 bp, Artificial Sequence
  sgRNA
  Tmem62_10
gtagtgctccaacagcaggg

SEQ ID NO: 61710 - DNA, 20 bp, Artificial Sequence
  sgRNA
  Tmem62_11
ttatagggtctcttaggccc

SEQ ID NO: 61711 - DNA, 20 bp, Artificial Sequence
  sgRNA
  Tmem62_12
cctgacagatgccaaaacaa

SEQ ID NO: 61712 - DNA, 20 bp, Artificial Sequence
  sgRNA
  Tmem62_13
ggcacgctggaacttgaggt

SEQ ID NO: 61713 - DNA, 20 bp, Artificial Sequence
  sgRNA
  Tmem62_14
tcaagatccaggcagagcgc

SEQ ID NO: 61714 - DNA, 20 bp, Artificial Sequence
  sgRNA
  Tmem62_15
agagcatcgccaattattac

SEQ ID NO: 61715 - DNA, 20 bp, Artificial Sequence
  sgRNA
  Tmem62_16
ttcaggtctcatctccacca

SEQ ID NO: 61716 - DNA, 20 bp, Artificial Sequence
  sgRNA
  Tmem62_17
gcatcagcccaccaagcgta

SEQ ID NO: 61717 - DNA, 20 bp, Artificial Sequence
  sgRNA
  Tmem62_18
tttgttggtgagataattga

SEQ ID NO: 61718 - DNA, 20 bp, Artificial Sequence
  sgRNA
  Tmem62_19
ccttactgaccactacattg

SEQ ID NO: 61719 - DNA, 20 bp, Artificial Sequence
  sgRNA
  Tmem62_20
ccagggatccggacagtaat

SEQ ID NO: 61720 - DNA, 20 bp, Artificial Sequence
  sgRNA
  Tmem63a_1
agatgcgtatcccacgtgtg

SEQ ID NO: 61721 - DNA, 20 bp, Artificial Sequence
  sgRNA
  Tmem63a_2
aaggtacctggtgagaccga

SEQ ID NO: 61722 - DNA, 20 bp, Artificial Sequence
  sgRNA
  Tmem63a_3
ccagggccttcggtgcaaag

SEQ ID NO: 61723 - DNA, 20 bp, Artificial Sequence
  sgRNA
  Tmem63a_4
cacccagcaagtctcccgag

SEQ ID NO: 61724 - DNA, 20 bp, Artificial Sequence
  sgRNA
  Tmem63a_5
gcttcatgtggcatcacaca

SEQ ID NO: 61725 - DNA, 20 bp, Artificial Sequence
  sgRNA
  Tmem63a_6
tcttctccagtttagccggg

SEQ ID NO: 61726 - DNA, 20 bp, Artificial Sequence
  sgRNA
  Tmem63a_7
gccaaaccgttcagaatccg

SEQ ID NO: 61727 - DNA, 20 bp, Artificial Sequence
  sgRNA
  Tmem63a_8
acatccaccacctcacacgt

SEQ ID NO: 61728 - DNA, 20 bp, Artificial Sequence
  sgRNA
  Tmem63a_9
agaagctgatcaccaccagc

SEQ ID NO: 61729 - DNA, 20 bp, Artificial Sequence
  sgRNA
  Tmem63a_10
gtgacaaaggccattcccag

SEQ ID NO: 61730 - DNA, 20 bp, Artificial Sequence
  sgRNA
  Tmem63a_11
gatgctgtaagccatgatga

SEQ ID NO: 61731 - DNA, 20 bp, Artificial Sequence
  sgRNA
  Tmem63a_12
gccacatgaagcccaccgtg

SEQ ID NO: 61732 - DNA, 20 bp, Artificial Sequence
  sgRNA
  Tmem63a_13
agtttggagccatgtatgcg

SEQ ID NO: 61733 - DNA, 20 bp, Artificial Sequence
  sgRNA
  Tmem63a_14
tagcctgattgaggtttccg

SEQ ID NO: 61734 - DNA, 20 bp, Artificial Sequence
  sgRNA
  Tmem63a_15
agtcccactgatgttacgga

SEQ ID NO: 61735 - DNA, 20 bp, Artificial Sequence
  sgRNA
  Tmem63a_16
ggtaacattgaacttgtcca

SEQ ID NO: 61736 - DNA, 20 bp, Artificial Sequence
  sgRNA
  Tmem63a_17
gagagctctgtgtctccaag

SEQ ID NO: 61737 - DNA, 20 bp, Artificial Sequence
  sgRNA
  Tmem63a_18
gaaggtgaagagcgtggccg

SEQ ID NO: 61738 - DNA, 20 bp, Artificial Sequence
  sgRNA
  Tmem63a_19
tgtccagctgtgctacagcg

SEQ ID NO: 61739 - DNA, 20 bp, Artificial Sequence
  sgRNA
  Tmem63a_20
tgatcatgcggaaggtatag

SEQ ID NO: 61740 - DNA, 20 bp, Artificial Sequence
  sgRNA
  Tmem63b_1
atgatcaaccccaaaccgtg

SEQ ID NO: 61741 - DNA, 20 bp, Artificial Sequence
  sgRNA
  Tmem63b_2
cagtagcgtagggaagaact

SEQ ID NO: 61742 - DNA, 20 bp, Artificial Sequence
  sgRNA
  Tmem63b_3
gctctgtcgactttgaccaa

SEQ ID NO: 61743 - DNA, 20 bp, Artificial Sequence
  sgRNA
  Tmem63b_4
aaagtgaacgagaaacctct

SEQ ID NO: 61744 - DNA, 20 bp, Artificial Sequence
  sgRNA
  Tmem63b_5
tgtgtgttcctgcccgacaa

SEQ ID NO: 61745 - DNA, 20 bp, Artificial Sequence
  sgRNA
  Tmem63b_6
aggtggcctgggactacggg

SEQ ID NO: 61746 - DNA, 20 bp, Artificial Sequence
  sgRNA
  Tmem63b_7
agcccggccctgttacaacg

SEQ ID NO: 61747 - DNA, 20 bp, Artificial Sequence
  sgRNA
  Tmem63b_8
cctggttcacagcccccgag

SEQ ID NO: 61748 - DNA, 20 bp, Artificial Sequence
  sgRNA
  Tmem63b_9
ttcaacgtgtgcaaatgcca

SEQ ID NO: 61749 - DNA, 20 bp, Artificial Sequence
  sgRNA
  Tmem63b_10
actggacaagaagatccact

SEQ ID NO: 61750 - DNA, 20 bp, Artificial Sequence
  sgRNA
  Tmem63b_11
ggcgttaccgataaaggctg

SEQ ID NO: 61751 - DNA, 20 bp, Artificial Sequence
  sgRNA
  Tmem63b_12
tcatgtacatgagtaggcct

SEQ ID NO: 61752 - DNA, 20 bp, Artificial Sequence
  sgRNA
  Tmem63b_13
agtcgagccacgttgtaaca

SEQ ID NO: 61753 - DNA, 20 bp, Artificial Sequence
  sgRNA
  Tmem63b_14
aggtcccctgagaagttgac

SEQ ID NO: 61754 - DNA, 20 bp, Artificial Sequence
  sgRNA
  Tmem63b_15
atcgtcctcctcccaagacg

SEQ ID NO: 61755 - DNA, 20 bp, Artificial Sequence
  sgRNA
  Tmem63b_16
tgagctccagaagtaatgga

SEQ ID NO: 61756 - DNA, 20 bp, Artificial Sequence
  sgRNA
  Tmem63b_17
ggtgctgcaggactcagagg

SEQ ID NO: 61757 - DNA, 20 bp, Artificial Sequence
  sgRNA
  Tmem63b_18
agcaccacagcagtagcgta

SEQ ID NO: 61758 - DNA, 20 bp, Artificial Sequence
  sgRNA
  Tmem63b_19
ttatgttccttgatgctgag

SEQ ID NO: 61759 - DNA, 20 bp, Artificial Sequence
  sgRNA
  Tmem63b_20
tctctactacgcctacttgc

SEQ ID NO: 61760 - DNA, 20 bp, Artificial Sequence
  sgRNA
  Tmem63c_1
cctgacctcactgatctacg

SEQ ID NO: 61761 - DNA, 20 bp, Artificial Sequence
  sgRNA
  Tmem63c_2
gattacaagtacatccattg

SEQ ID NO: 61762 - DNA, 20 bp, Artificial Sequence
  sgRNA
  Tmem63c_3
gaatgaccaccataaacacc

SEQ ID NO: 61763 - DNA, 20 bp, Artificial Sequence
  sgRNA
  Tmem63c_4
tctcccaactccagttcacg

SEQ ID NO: 61764 - DNA, 20 bp, Artificial Sequence
  sgRNA
  Tmem63c_5
gagtccaccaactgaagcgg

SEQ ID NO: 61765 - DNA, 20 bp, Artificial Sequence
  sgRNA
  Tmem63c_6
agtttggacgagagtatgca

SEQ ID NO: 61766 - DNA, 20 bp, Artificial Sequence
  sgRNA
  Tmem63c_7
cgtcaaaaactaccactgga

SEQ ID NO: 61767 - DNA, 20 bp, Artificial Sequence
  sgRNA
  Tmem63c_8
tgttgagtacgagcacggtg

SEQ ID NO: 61768 - DNA, 20 bp, Artificial Sequence
  sgRNA
  Tmem63c_9
ggaagctccggattgcccaa

SEQ ID NO: 61769 - DNA, 20 bp, Artificial Sequence
  sgRNA
  Tmem63c_10
agtcccacgcagctttccgg

SEQ ID NO: 61770 - DNA, 20 bp, Artificial Sequence
  sgRNA
  Tmem63c_11
tgagaagtcatctccgtcag

SEQ ID NO: 61771 - DNA, 20 bp, Artificial Sequence
  sgRNA
  Tmem63c_12
gccgataagtagaccagcag

SEQ ID NO: 61772 - DNA, 20 bp, Artificial Sequence
  sgRNA
  Tmem63c_13
gtagtagagcctgccccgca

SEQ ID NO: 61773 - DNA, 20 bp, Artificial Sequence
  sgRNA
  Tmem63c_14
ctacttatcggccttcctag

SEQ ID NO: 61774 - DNA, 20 bp, Artificial Sequence
  sgRNA
  Tmem63c_15
atgttggacctgcttcaagg

SEQ ID NO: 61775 - DNA, 20 bp, Artificial Sequence
  sgRNA
  Tmem63c_16
gcctccaaggaaacctctga

SEQ ID NO: 61776 - DNA, 20 bp, Artificial Sequence
  sgRNA
  Tmem63c_17
ggtgacattgtatatgtcga

SEQ ID NO: 61777 - DNA, 20 bp, Artificial Sequence
  sgRNA
  Tmem63c_18
ccaccaactgaagcggcgga

SEQ ID NO: 61778 - DNA, 20 bp, Artificial Sequence
  sgRNA
  Tmem63c_19
gatgttgagtacgagcacgg

SEQ ID NO: 61779 - DNA, 20 bp, Artificial Sequence
  sgRNA
  Tmem63c_20
tgaatgagtgcttccagtcg

SEQ ID NO: 61780 - DNA, 20 bp, Artificial Sequence
  sgRNA
  Tmem67_1
tcacaaatgttggttcgcag

SEQ ID NO: 61781 - DNA, 20 bp, Artificial Sequence
  sgRNA
  Tmem67_2
attgattgggaacggccgaa

SEQ ID NO: 61782 - DNA, 20 bp, Artificial Sequence
  sgRNA
  Tmem67_3
ttgctacccagatttcactg

SEQ ID NO: 61783 - DNA, 20 bp, Artificial Sequence
  sgRNA
  Tmem67_4
gctgcttcctatgatatacg

SEQ ID NO: 61784 - DNA, 20 bp, Artificial Sequence
  sgRNA
  Tmem67_5
ccgcattctgagatatgccg

SEQ ID NO: 61785 - DNA, 20 bp, Artificial Sequence
  sgRNA
  Tmem67_6
gtttggtgcccaacacggat

SEQ ID NO: 61786 - DNA, 20 bp, Artificial Sequence
  sgRNA
  Tmem67_7
gcgccgagatgtcaaagtac

SEQ ID NO: 61787 - DNA, 20 bp, Artificial Sequence
  sgRNA
  Tmem67_8
tatgaaccttaagagagagg

SEQ ID NO: 61788 - DNA, 20 bp, Artificial Sequence
  sgRNA
  Tmem67_9
agcacaggtcaacaaactgc

SEQ ID NO: 61789 - DNA, 20 bp, Artificial Sequence
  sgRNA
  Tmem67_10
tgttagtgtctgcatggccg

SEQ ID NO: 61790 - DNA, 20 bp, Artificial Sequence
  sgRNA
  Tmem67_11
aggccttgtacgcgtcacca

SEQ ID NO: 61791 - DNA, 20 bp, Artificial Sequence
  sgRNA
  Tmem67_12
ccagactgctgagttcgtcg

SEQ ID NO: 61792 - DNA, 20 bp, Artificial Sequence
  sgRNA
  Tmem67_13
ggattcatgagactttaaca

SEQ ID NO: 61793 - DNA, 20 bp, Artificial Sequence
  sgRNA
  Tmem67_14
cgttcttcctgaactggcat

SEQ ID NO: 61794 - DNA, 20 bp, Artificial Sequence
  sgRNA
  Tmem67_15
agaacgagatctgaccgcca

SEQ ID NO: 61795 - DNA, 20 bp, Artificial Sequence
  sgRNA
  Tmem67_16
agtgggcgagaaaatgacct

SEQ ID NO: 61796 - DNA, 20 bp, Artificial Sequence
  sgRNA
  Tmem67_17
tgtgctgtattatgggaacg

SEQ ID NO: 61797 - DNA, 20 bp, Artificial Sequence
  sgRNA
  Tmem67_18
caaggaacttattcattgcg

SEQ ID NO: 61798 - DNA, 20 bp, Artificial Sequence
  sgRNA
  Tmem67_19
gattatgtttcagcaacaca

SEQ ID NO: 61799 - DNA, 20 bp, Artificial Sequence
  sgRNA
  Tmem67_20
gtaatttccactgcacgtta

SEQ ID NO: 61800 - DNA, 20 bp, Artificial Sequence
  sgRNA
  Tmem8_1
ggcccacagtcattcaaaca

SEQ ID NO: 61801 - DNA, 20 bp, Artificial Sequence
  sgRNA
  Tmem8_2
gcttgaatgcactagcacga

SEQ ID NO: 61802 - DNA, 20 bp, Artificial Sequence
  sgRNA
  Tmem8_3
gcaaatggcaggatggagcg

SEQ ID NO: 61803 - DNA, 20 bp, Artificial Sequence
  sgRNA
  Tmem8_4
agggtgggagatgttgactg

SEQ ID NO: 61804 - DNA, 20 bp, Artificial Sequence
  sgRNA
  Tmem8_5
cctgcctagaaacttccaga

SEQ ID NO: 61805 - DNA, 20 bp, Artificial Sequence
  sgRNA
  Tmem8_6
atacacccaggagcttcggt

SEQ ID NO: 61806 - DNA, 20 bp, Artificial Sequence
  sgRNA
  Tmem8_7
tgtccatgcctgtatcaagg

SEQ ID NO: 61807 - DNA, 20 bp, Artificial Sequence
  sgRNA
  Tmem8_8
actgtagcgtgtcataactg

SEQ ID NO: 61808 - DNA, 20 bp, Artificial Sequence
  sgRNA
  Tmem8_9
agtatacatggcgatgccaa

SEQ ID NO: 61809 - DNA, 20 bp, Artificial Sequence
  sgRNA
  Tmem8_10
tgaacaggctgtggttcgcg

SEQ ID NO: 61810 - DNA, 20 bp, Artificial Sequence
  sgRNA
  Tmem8_11
gcagaccgtagcccagcaga

SEQ ID NO: 61811 - DNA, 20 bp, Artificial Sequence
  sgRNA
  Tmem8_12
ccacgcctgtgaccaacccg

SEQ ID NO: 61812 - DNA, 20 bp, Artificial Sequence
  sgRNA
  Tmem8_13
gatacaggcatggacagcgg

SEQ ID NO: 61813 - DNA, 20 bp, Artificial Sequence
  sgRNA
  Tmem8_14
tccttgcagatggatcgcag

SEQ ID NO: 61814 - DNA, 20 bp, Artificial Sequence
  sgRNA
  Tmem8_15
tcattaccagcatatcaggc

SEQ ID NO: 61815 - DNA, 20 bp, Artificial Sequence
  sgRNA
  Tmem8_16
gctgaacctcatgtgacagt

SEQ ID NO: 61816 - DNA, 20 bp, Artificial Sequence
  sgRNA
  Tmem8_17
tgatggatggtcacactcca

SEQ ID NO: 61817 - DNA, 20 bp, Artificial Sequence
  sgRNA
  Tmem8_18
atataccgctgtgggcaccg

SEQ ID NO: 61818 - DNA, 20 bp, Artificial Sequence
  sgRNA
  Tmem8_19
cttcacctggatcttctggg

SEQ ID NO: 61819 - DNA, 20 bp, Artificial Sequence
  sgRNA
  Tmem8_20
agaggacagtagcaaatggc

SEQ ID NO: 61820 - DNA, 20 bp, Artificial Sequence
  sgRNA
  Tmem87a_1
gttgacttacaatcatcagt

SEQ ID NO: 61821 - DNA, 20 bp, Artificial Sequence
  sgRNA
  Tmem87a_2
aggagtcctcagagttacag

SEQ ID NO: 61822 - DNA, 20 bp, Artificial Sequence
  sgRNA
  Tmem87a_3
tttcagaatatccgatacaa

SEQ ID NO: 61823 - DNA, 20 bp, Artificial Sequence
  sgRNA
  Tmem87a_4
agatgaaatagagtcatact

SEQ ID NO: 61824 - DNA, 20 bp, Artificial Sequence
  sgRNA
  Tmem87a_5
tcatacttggaaaatctcaa

SEQ ID NO: 61825 - DNA, 20 bp, Artificial Sequence
  sgRNA
  Tmem87a_6
cagaatagtgacttgccagt

SEQ ID NO: 61826 - DNA, 20 bp, Artificial Sequence
  sgRNA
  Tmem87a_7
tgaagagtgactccaaggcg

SEQ ID NO: 61827 - DNA, 20 bp, Artificial Sequence
  sgRNA
  Tmem87a_8
ggccatcagcaaataaccag

SEQ ID NO: 61828 - DNA, 20 bp, Artificial Sequence
  sgRNA
  Tmem87a_9
cagactgactatgatgacca

SEQ ID NO: 61829 - DNA, 20 bp, Artificial Sequence
  sgRNA
  Tmem87a_10
cgatctatctgcagcaaaca

SEQ ID NO: 61830 - DNA, 20 bp, Artificial Sequence
  sgRNA
  Tmem87a_11
gcatcttgccaagtctgcaa

SEQ ID NO: 61831 - DNA, 20 bp, Artificial Sequence
  sgRNA
  Tmem87a_12
ggccttgctggactcagacg

SEQ ID NO: 61832 - DNA, 20 bp, Artificial Sequence
  sgRNA
  Tmem87a_13
gatctatctgcagcaaacac

SEQ ID NO: 61833 - DNA, 20 bp, Artificial Sequence
  sgRNA
  Tmem87a_14
gtaccaagcaggaaccaaat

SEQ ID NO: 61834 - DNA, 20 bp, Artificial Sequence
  sgRNA
  Tmem87a_15
tgaagctattaaaacttcgg

SEQ ID NO: 61835 - DNA, 20 bp, Artificial Sequence
  sgRNA
  Tmem87a_16
tcctcatcttcctctgacaa

SEQ ID NO: 61836 - DNA, 20 bp, Artificial Sequence
  sgRNA
  Tmem87a_17
tttactttactagtcccatt

SEQ ID NO: 61837 - DNA, 20 bp, Artificial Sequence
  sgRNA
  Tmem87a_18
ggaaaacagcaatctccaaa

SEQ ID NO: 61838 - DNA, 20 bp, Artificial Sequence
  sgRNA
  Tmem87a_19
gcgctcactggctcgaaccc

SEQ ID NO: 61839 - DNA, 20 bp, Artificial Sequence
  sgRNA
  Tmem87a_20
ccaaagctttccttcagcat

SEQ ID NO: 61840 - DNA, 20 bp, Artificial Sequence
  sgRNA
  Tmem87b_1
gcagatactcacattcaatg

SEQ ID NO: 61841 - DNA, 20 bp, Artificial Sequence
  sgRNA
  Tmem87b_2
caatgattaccctgatctgg

SEQ ID NO: 61842 - DNA, 20 bp, Artificial Sequence
  sgRNA
  Tmem87b_3
gatgcagagatgtacccatg

SEQ ID NO: 61843 - DNA, 20 bp, Artificial Sequence
  sgRNA
  Tmem87b_4
tgcatcactgttcctaagcg

SEQ ID NO: 61844 - DNA, 20 bp, Artificial Sequence
  sgRNA
  Tmem87b_5
tcatcagagtcatctatcaa

SEQ ID NO: 61845 - DNA, 20 bp, Artificial Sequence
  sgRNA
  Tmem87b_6
catctgagtccactaacact

SEQ ID NO: 61846 - DNA, 20 bp, Artificial Sequence
  sgRNA
  Tmem87b_7
gctcgggctttggacgagga

SEQ ID NO: 61847 - DNA, 20 bp, Artificial Sequence
  sgRNA
  Tmem87b_8
ggtacatctctgcatcagac

SEQ ID NO: 61848 - DNA, 20 bp, Artificial Sequence
  sgRNA
  Tmem87b_9
ccgagctcgggctttggacg

SEQ ID NO: 61849 - DNA, 20 bp, Artificial Sequence
  sgRNA
  Tmem87b_10
tctcctgtgctgggtcccgg

SEQ ID NO: 61850 - DNA, 20 bp, Artificial Sequence
  sgRNA
  Tmem87b_11
ttcaagccaggaaggatcaa

SEQ ID NO: 61851 - DNA, 20 bp, Artificial Sequence
  sgRNA
  Tmem87b_12
ccatgtccttccaaaatagt

SEQ ID NO: 61852 - DNA, 20 bp, Artificial Sequence
  sgRNA
  Tmem87b_13
gcagtcccagtccaatcacc

SEQ ID NO: 61853 - DNA, 20 bp, Artificial Sequence
  sgRNA
  Tmem87b_14
ggccgtcagcaaataatcag

SEQ ID NO: 61854 - DNA, 20 bp, Artificial Sequence
  sgRNA
  Tmem87b_15
gacccagcacaggagacaca

SEQ ID NO: 61855 - DNA, 20 bp, Artificial Sequence
  sgRNA
  Tmem87b_16
gcctcaaaaacggtttcaaa

SEQ ID NO: 61856 - DNA, 20 bp, Artificial Sequence
  sgRNA
  Tmem87b_17
tcatctgagtccactaacac

SEQ ID NO: 61857 - DNA, 20 bp, Artificial Sequence
  sgRNA
  Tmem87b_18
tgattaccctgatctggagg

SEQ ID NO: 61858 - DNA, 20 bp, Artificial Sequence
  sgRNA
  Tmem87b_19
aggcgtcatgagagtcatcg

SEQ ID NO: 61859 - DNA, 20 bp, Artificial Sequence
  sgRNA
  Tmem87b_20
gcttaggaacagtgatgcac

SEQ ID NO: 61860 - DNA, 20 bp, Artificial Sequence
  sgRNA
  Tmem8b_1
gaatccataggtgagcgcgt

SEQ ID NO: 61861 - DNA, 20 bp, Artificial Sequence
  sgRNA
  Tmem8b_2
cagcacgtatcggctccgaa

SEQ ID NO: 61862 - DNA, 20 bp, Artificial Sequence
  sgRNA
  Tmem8b_3
attcggatgcctgactcatg

SEQ ID NO: 61863 - DNA, 20 bp, Artificial Sequence
  sgRNA
  Tmem8b_4
gcccagctgtatttgccctg

SEQ ID NO: 61864 - DNA, 20 bp, Artificial Sequence
  sgRNA
  Tmem8b_5
tggagcccagacctgagtcg

SEQ ID NO: 61865 - DNA, 20 bp, Artificial Sequence
  sgRNA
  Tmem8b_6
ggaacgtgtcctcaggaacg

SEQ ID NO: 61866 - DNA, 20 bp, Artificial Sequence
  sgRNA
  Tmem8b_7
caggggcttaagcaaacgcg

SEQ ID NO: 61867 - DNA, 20 bp, Artificial Sequence
  sgRNA
  Tmem8b_8
gcacttctgccgttgcattg

SEQ ID NO: 61868 - DNA, 20 bp, Artificial Sequence
  sgRNA
  Tmem8b_9
gtacaaggctgaacgattat

SEQ ID NO: 61869 - DNA, 20 bp, Artificial Sequence
  sgRNA
  Tmem8b_10
ggacagcagctggaatccat

SEQ ID NO: 61870 - DNA, 20 bp, Artificial Sequence
  sgRNA
  Tmem8b_11
gcatgttcatggcagcccca

SEQ ID NO: 61871 - DNA, 20 bp, Artificial Sequence
  sgRNA
  Tmem8b_12
caccccgcacagagaacgga

SEQ ID NO: 61872 - DNA, 20 bp, Artificial Sequence
  sgRNA
  Tmem8b_13
gaccctccgttctctgtgcg

SEQ ID NO: 61873 - DNA, 20 bp, Artificial Sequence
  sgRNA
  Tmem8b_14
gctgtgcatcaatgaacagg

SEQ ID NO: 61874 - DNA, 20 bp, Artificial Sequence
  sgRNA
  Tmem8b_15
ggtggcgctgaactgagcac

SEQ ID NO: 61875 - DNA, 20 bp, Artificial Sequence
  sgRNA
  Tmem8b_16
tgcagcggattgatgacggg

SEQ ID NO: 61876 - DNA, 20 bp, Artificial Sequence
  sgRNA
  Tmem8b_17
ttgcccaagtctcttccact

SEQ ID NO: 61877 - DNA, 20 bp, Artificial Sequence
  sgRNA
  Tmem8b_18
cggtcagtcttggcacgggg

SEQ ID NO: 61878 - DNA, 20 bp, Artificial Sequence
  sgRNA
  Tmem8b_19
ggtagagtatgagagaggcg

SEQ ID NO: 61879 - DNA, 20 bp, Artificial Sequence
  sgRNA
  Tmem8b_20
ccaggtccccgcttcaaccc

SEQ ID NO: 61880 - DNA, 20 bp, Artificial Sequence
  sgRNA
  Tmem9_1
ggcagtaggcttccacatcg

SEQ ID NO: 61881 - DNA, 20 bp, Artificial Sequence
  sgRNA
  Tmem9_2
gctctgcgagtgtaggtacg

SEQ ID NO: 61882 - DNA, 20 bp, Artificial Sequence
  sgRNA
  Tmem9_3
caaccagaatgtgtctcaga

SEQ ID NO: 61883 - DNA, 20 bp, Artificial Sequence
  sgRNA
  Tmem9_4
ccgctgatgtttctgtaagg

SEQ ID NO: 61884 - DNA, 20 bp, Artificial Sequence
  sgRNA
  Tmem9_5
gggtcctccaatggacgcag

SEQ ID NO: 61885 - DNA, 20 bp, Artificial Sequence
  sgRNA
  Tmem9_6
gcatctggcttccggatgag

SEQ ID NO: 61886 - DNA, 20 bp, Artificial Sequence
  sgRNA
  Tmem9_7
gcatgggctccaccacatgc

SEQ ID NO: 61887 - DNA, 20 bp, Artificial Sequence
  sgRNA
  Tmem9_8
gggtggaaggcgctcagcag

SEQ ID NO: 61888 - DNA, 20 bp, Artificial Sequence
  sgRNA
  Tmem9_9
tcgtggccaggcactggcat

SEQ ID NO: 61889 - DNA, 20 bp, Artificial Sequence
  sgRNA
  Tmem9_10
gcggacagatgcatttgcac

SEQ ID NO: 61890 - DNA, 20 bp, Artificial Sequence
  sgRNA
  Tmem9_11
gtttgcccggggtcctccaa

SEQ ID NO: 61891 - DNA, 20 bp, Artificial Sequence
  sgRNA
  Tmem9_12
tggaaggcgctcagcagcgg

SEQ ID NO: 61892 - DNA, 20 bp, Artificial Sequence
  sgRNA
  Tmem9_13
tccaggacagtgtttgcccg

SEQ ID NO: 61893 - DNA, 20 bp, Artificial Sequence
  sgRNA
  Tmem9_14
gggcaaacactgtcctggag

SEQ ID NO: 61894 - DNA, 20 bp, Artificial Sequence
  sgRNA
  Tmem9_15
ccgccttacagaaacatcag

SEQ ID NO: 61895 - DNA, 20 bp, Artificial Sequence
  sgRNA
  Tmem9_16
gctccaggacagtgtttgcc

SEQ ID NO: 61896 - DNA, 20 bp, Artificial Sequence
  sgRNA
  Tmem9_17
tgagcagctgcacaatgaag

SEQ ID NO: 61897 - DNA, 20 bp, Artificial Sequence
  sgRNA
  Tmem9_18
actgcctgctctgcgagtgt

SEQ ID NO: 61898 - DNA, 20 bp, Artificial Sequence
  sgRNA
  Tmem9_19
agagggcccccaccacagac

SEQ ID NO: 61899 - DNA, 20 bp, Artificial Sequence
  sgRNA
  Tmem9_20
acactcgcagagcaggcagt

SEQ ID NO: 61900 - DNA, 20 bp, Artificial Sequence
  sgRNA
  Tmem95_1
ccagtataatggaatcaagg

SEQ ID NO: 61901 - DNA, 20 bp, Artificial Sequence
  sgRNA
  Tmem95_2
acgacagaagatacaagcct

SEQ ID NO: 61902 - DNA, 20 bp, Artificial Sequence
  sgRNA
  Tmem95_3
ggcaaaggccgagaaatctg

SEQ ID NO: 61903 - DNA, 20 bp, Artificial Sequence
  sgRNA
  Tmem95_4
caggatcccccagtacacca

SEQ ID NO: 61904 - DNA, 20 bp, Artificial Sequence
  sgRNA
  Tmem95_5
ggacaattccgaagatacat

SEQ ID NO: 61905 - DNA, 20 bp, Artificial Sequence
  sgRNA
  Tmem95_6
tcatgccttggcaaaccgcc

SEQ ID NO: 61906 - DNA, 20 bp, Artificial Sequence
  sgRNA
  Tmem95_7
gaagatacaagccttggcca

SEQ ID NO: 61907 - DNA, 20 bp, Artificial Sequence
  sgRNA
  Tmem95_8
gtacaactgctccacctgcg

SEQ ID NO: 61908 - DNA, 20 bp, Artificial Sequence
  sgRNA
  Tmem95_9
gggtggggctttcttggccg

SEQ ID NO: 61909 - DNA, 20 bp, Artificial Sequence
  sgRNA
  Tmem95_10
tcgtctccaagatcatgcct

SEQ ID NO: 61910 - DNA, 20 bp, Artificial Sequence
  sgRNA
  Tmem95_11
ggttattgagctgagccagg

SEQ ID NO: 61911 - DNA, 20 bp, Artificial Sequence
  sgRNA
  Tmem95_12
ataaccagacgaagccgaag

SEQ ID NO: 61912 - DNA, 20 bp, Artificial Sequence
  sgRNA
  Tmem95_13
atttccacttcggcttcgtc

SEQ ID NO: 61913 - DNA, 20 bp, Artificial Sequence
  sgRNA
  Tmem95_14
gtcacgatctgtgggacgct

SEQ ID NO: 61914 - DNA, 20 bp, Artificial Sequence
  sgRNA
  Tmem95_15
attctgctcctatgtatctt

SEQ ID NO: 61915 - DNA, 20 bp, Artificial Sequence
  sgRNA
  Tmem95_16
ggtggagcagttgtacagga

SEQ ID NO: 61916 - DNA, 20 bp, Artificial Sequence
  sgRNA
  Tmem95_17
tacaactgctccacctgcga

SEQ ID NO: 61917 - DNA, 20 bp, Artificial Sequence
  sgRNA
  Tmem95_18
agactcctccttgccctcgc

SEQ ID NO: 61918 - DNA, 20 bp, Artificial Sequence
  sgRNA
  Tmem95_19
tgattccattatactggcaa

SEQ ID NO: 61919 - DNA, 20 bp, Artificial Sequence
  sgRNA
  Tmem95_20
tctggttattgagctgagcc

SEQ ID NO: 61920 - DNA, 20 bp, Artificial Sequence
  sgRNA
  Tmem9b_1
gtggagcccatgcctgtacg

SEQ ID NO: 61921 - DNA, 20 bp, Artificial Sequence
  sgRNA
  Tmem9b_2
ttcttattataaatgtgccc

SEQ ID NO: 61922 - DNA, 20 bp, Artificial Sequence
  sgRNA
  Tmem9b_3
gagaagctctgtcacaatca

SEQ ID NO: 61923 - DNA, 20 bp, Artificial Sequence
  sgRNA
  Tmem9b_4
cacgacatgaaggcaatcac

SEQ ID NO: 61924 - DNA, 20 bp, Artificial Sequence
  sgRNA
  Tmem9b_5
tatggtgcggaaacctgctg

SEQ ID NO: 61925 - DNA, 20 bp, Artificial Sequence
  sgRNA
  Tmem9b_6
tcaggtccccgtacaggcat

SEQ ID NO: 61926 - DNA, 20 bp, Artificial Sequence
  sgRNA
  Tmem9b_7
gcatgggctccacgacatga

SEQ ID NO: 61927 - DNA, 20 bp, Artificial Sequence
  sgRNA
  Tmem9b_8
ttgcagagcgatgatgacgt

SEQ ID NO: 61928 - DNA, 20 bp, Artificial Sequence
  sgRNA
  Tmem9b_9
gcagcagcaccgacagcgcc

SEQ ID NO: 61929 - DNA, 20 bp, Artificial Sequence
  sgRNA
  Tmem9b_10
ccttgtttagaacattggct

SEQ ID NO: 61930 - DNA, 20 bp, Artificial Sequence
  sgRNA
  Tmem9b_11
tagttgagcccatcctgaag

SEQ ID NO: 61931 - DNA, 20 bp, Artificial Sequence
  sgRNA
  Tmem9b_12
aagaggcgcctcttcaggat

SEQ ID NO: 61932 - DNA, 20 bp, Artificial Sequence
  sgRNA
  Tmem9b_13
agagcgggccagcacatcat

SEQ ID NO: 61933 - DNA, 20 bp, Artificial Sequence
  sgRNA
  Tmem9b_14
catgggcatttgcaaaaggc

SEQ ID NO: 61934 - DNA, 20 bp, Artificial Sequence
  sgRNA
  Tmem9b_15
ccaggattctctttataggg

SEQ ID NO: 61935 - DNA, 20 bp, Artificial Sequence
  sgRNA
  Tmem9b_16
atcatcgctctgcaacagct

SEQ ID NO: 61936 - DNA, 20 bp, Artificial Sequence
  sgRNA
  Tmem9b_17
gcagcaggtttccgcaccat

SEQ ID NO: 61937 - DNA, 20 bp, Artificial Sequence
  sgRNA
  Tmem9b_18
tctacatcaggtccccgtac

SEQ ID NO: 61938 - DNA, 20 bp, Artificial Sequence
  sgRNA
  Tmem9b_19
agccaatgttctaaacaagg

SEQ ID NO: 61939 - DNA, 20 bp, Artificial Sequence
  sgRNA
  Tmem9b_20
catcatcgctctgcaacagc

SEQ ID NO: 61940 - DNA, 20 bp, Artificial Sequence
  sgRNA
  Tmigd1_1
tggcaatggcttccaaaccg

SEQ ID NO: 61941 - DNA, 20 bp, Artificial Sequence
  sgRNA
  Tmigd1_2
tgctgttcaaaaccacaccg

SEQ ID NO: 61942 - DNA, 20 bp, Artificial Sequence
  sgRNA
  Tmigd1_3
tatattctggacactcaaca

SEQ ID NO: 61943 - DNA, 20 bp, Artificial Sequence
  sgRNA
  Tmigd1_4
cccatcaacgaaagtgacaa

SEQ ID NO: 61944 - DNA, 20 bp, Artificial Sequence
  sgRNA
  Tmigd1_5
tgtcgtggtcgtcctgacga

SEQ ID NO: 61945 - DNA, 20 bp, Artificial Sequence
  sgRNA
  Tmigd1_6
caagctacagcgcgatcaga

SEQ ID NO: 61946 - DNA, 20 bp, Artificial Sequence
  sgRNA
  Tmigd1_7
accacatcatttgcgcttga

SEQ ID NO: 61947 - DNA, 20 bp, Artificial Sequence
  sgRNA
  Tmigd1_8
aagccattgccacttagaag

SEQ ID NO: 61948 - DNA, 20 bp, Artificial Sequence
  sgRNA
  Tmigd1_9
ttgtctggtggatttggtga

SEQ ID NO: 61949 - DNA, 20 bp, Artificial Sequence
  sgRNA
  Tmigd1_10
ggaatagtagatctgaaaaa

SEQ ID NO: 61950 - DNA, 20 bp, Artificial Sequence
  sgRNA
  Tmigd1_11
tcaccaaatccaccagacaa

SEQ ID NO: 61951 - DNA, 20 bp, Artificial Sequence
  sgRNA
  Tmigd1_12
catcattgctgcttgtgtcg

SEQ ID NO: 61952 - DNA, 20 bp, Artificial Sequence
  sgRNA
  Tmigd1_13
gaaaagactcccttgtctgg

SEQ ID NO: 61953 - DNA, 20 bp, Artificial Sequence
  sgRNA
  Tmigd1_14
catcatttgcgcttgagggt

SEQ ID NO: 61954 - DNA, 20 bp, Artificial Sequence
  sgRNA
  Tmigd1_15
gtataaaaacaacagcgcct

SEQ ID NO: 61955 - DNA, 20 bp, Artificial Sequence
  sgRNA
  Tmigd1_16
acgacacaagcagcaatgat

SEQ ID NO: 61956 - DNA, 20 bp, Artificial Sequence
  sgRNA
  Tmigd1_17
tgagctggcaatacagctgt

SEQ ID NO: 61957 - DNA, 20 bp, Artificial Sequence
  sgRNA
  Tmigd1_18
aagtcaagaaatctgacaat

SEQ ID NO: 61958 - DNA, 20 bp, Artificial Sequence
  sgRNA
  Tmigd1_19
gctgtagcttgcaggtaaag

SEQ ID NO: 61959 - DNA, 20 bp, Artificial Sequence
  sgRNA
  Tmigd1_20
ccattgtcactttcgttgat

SEQ ID NO: 61960 - DNA, 20 bp, Artificial Sequence
  sgRNA
  Tmprss11d_1
tacggagctgtacccgtcgt

SEQ ID NO: 61961 - DNA, 20 bp, Artificial Sequence
  sgRNA
  Tmprss11d_2
ctcaataatgtccaccactg

SEQ ID NO: 61962 - DNA, 20 bp, Artificial Sequence
  sgRNA
  Tmprss11d_3
cctaaacgttgaatacactg

SEQ ID NO: 61963 - DNA, 20 bp, Artificial Sequence
  sgRNA
  Tmprss11d_4
tcgttgtcataataacggta

SEQ ID NO: 61964 - DNA, 20 bp, Artificial Sequence
  sgRNA
  Tmprss11d_5
tgtggcctcccaaataagcc

SEQ ID NO: 61965 - DNA, 20 bp, Artificial Sequence
  sgRNA
  Tmprss11d_6
gcagtcacaaatctacggca

SEQ ID NO: 61966 - DNA, 20 bp, Artificial Sequence
  sgRNA
  Tmprss11d_7
gctcattgtagaaaccccaa

SEQ ID NO: 61967 - DNA, 20 bp, Artificial Sequence
  sgRNA
  Tmprss11d_8
aatacgccagctggttacag

SEQ ID NO: 61968 - DNA, 20 bp, Artificial Sequence
  sgRNA
  Tmprss11d_9
agctgtagactgacttgcca

SEQ ID NO: 61969 - DNA, 20 bp, Artificial Sequence
  sgRNA
  Tmprss11d_10
ggttctgtcgcatatgttac

SEQ ID NO: 61970 - DNA, 20 bp, Artificial Sequence
  sgRNA
  Tmprss11d_11
agctttcgttgtcataataa

SEQ ID NO: 61971 - DNA, 20 bp, Artificial Sequence
  sgRNA
  Tmprss11d_12
cattgtagaaaccccaaagg

SEQ ID NO: 61972 - DNA, 20 bp, Artificial Sequence
  sgRNA
  Tmprss11d_13
tagtaaacgtaacaacagaa

SEQ ID NO: 61973 - DNA, 20 bp, Artificial Sequence
  sgRNA
  Tmprss11d_14
ctgtctgatccagttgcggt

SEQ ID NO: 61974 - DNA, 20 bp, Artificial Sequence
  sgRNA
  Tmprss11d_15
tctgctgtctgatccagttg

SEQ ID NO: 61975 - DNA, 20 bp, Artificial Sequence
  sgRNA
  Tmprss11d_16
gggtttctacaatgagccct

SEQ ID NO: 61976 - DNA, 20 bp, Artificial Sequence
  sgRNA
  Tmprss11d_17
acacttccactgtaaccagc

SEQ ID NO: 61977 - DNA, 20 bp, Artificial Sequence
  sgRNA
  Tmprss11d_18
tggaatgcgttcaggggccg

SEQ ID NO: 61978 - DNA, 20 bp, Artificial Sequence
  sgRNA
  Tmprss11d_19
atattggacagccacctttg

SEQ ID NO: 61979 - DNA, 20 bp, Artificial Sequence
  sgRNA
  Tmprss11d_20
cacaaatctacggcaaggag

SEQ ID NO: 61980 - DNA, 20 bp, Artificial Sequence
  sgRNA
  Tmprss11e_1
tttcataaatctccactacg

SEQ ID NO: 61981 - DNA, 20 bp, Artificial Sequence
  sgRNA
  Tmprss11e_2
tgactcaggatcaacattgg

SEQ ID NO: 61982 - DNA, 20 bp, Artificial Sequence
  sgRNA
  Tmprss11e_3
ctacagtacagactagtgtg

SEQ ID NO: 61983 - DNA, 20 bp, Artificial Sequence
  sgRNA
  Tmprss11e_4
caacctcgaaaactgacgac

SEQ ID NO: 61984 - DNA, 20 bp, Artificial Sequence
  sgRNA
  Tmprss11e_5
agtccacctgtacttgccga

SEQ ID NO: 61985 - DNA, 20 bp, Artificial Sequence
  sgRNA
  Tmprss11e_6
aatcagcctcaatcttacaa

SEQ ID NO: 61986 - DNA, 20 bp, Artificial Sequence
  sgRNA
  Tmprss11e_7
gtttcacccagaataacctt

SEQ ID NO: 61987 - DNA, 20 bp, Artificial Sequence
  sgRNA
  Tmprss11e_8
gaaatgatgccgataaccca

SEQ ID NO: 61988 - DNA, 20 bp, Artificial Sequence
  sgRNA
  Tmprss11e_9
gactcaggatcaacattggg

SEQ ID NO: 61989 - DNA, 20 bp, Artificial Sequence
  sgRNA
  Tmprss11e_10
ctaacatctgcagtaacaag

SEQ ID NO: 61990 - DNA, 20 bp, Artificial Sequence
  sgRNA
  Tmprss11e_11
gcaaaccatgagtttcagcc

SEQ ID NO: 61991 - DNA, 20 bp, Artificial Sequence
  sgRNA
  Tmprss11e_12
caaaccatgagtttcagccg

SEQ ID NO: 61992 - DNA, 20 bp, Artificial Sequence
  sgRNA
  Tmprss11e_13
gtaagattgaggctgattgc

SEQ ID NO: 61993 - DNA, 20 bp, Artificial Sequence
  sgRNA
  Tmprss11e_14
actggcagaactgtctaagc

SEQ ID NO: 61994 - DNA, 20 bp, Artificial Sequence
  sgRNA
  Tmprss11e_15
gtacttgccgaaggttattc

SEQ ID NO: 61995 - DNA, 20 bp, Artificial Sequence
  sgRNA
  Tmprss11e_16
tatgcactgcatttgtgcag

SEQ ID NO: 61996 - DNA, 20 bp, Artificial Sequence
  sgRNA
  Tmprss11e_17
tgaaaagctgaagtatgcta

SEQ ID NO: 61997 - DNA, 20 bp, Artificial Sequence
  sgRNA
  Tmprss11e_18
atgagtttcagccggggcag

SEQ ID NO: 61998 - DNA, 20 bp, Artificial Sequence
  sgRNA
  Tmprss11e_19
tggagggacaccagtagaag

SEQ ID NO: 61999 - DNA, 20 bp, Artificial Sequence
  sgRNA
  Tmprss11e_20
aaggtagcactccatctgga

SEQ ID NO: 62000 - DNA, 20 bp, Artificial Sequence
  sgRNA
  Tmprss13_1
cagcgcttaccgaacaactg

SEQ ID NO: 62001 - DNA, 20 bp, Artificial Sequence
  sgRNA
  Tmprss13_2
ggtcgcaatgtccttcccgg

SEQ ID NO: 62002 - DNA, 20 bp, Artificial Sequence
  sgRNA
  Tmprss13_3
tgttagagcaacaccagtgg

SEQ ID NO: 62003 - DNA, 20 bp, Artificial Sequence
  sgRNA
  Tmprss13_4
aaaatgaagagcgatgagct

SEQ ID NO: 62004 - DNA, 20 bp, Artificial Sequence
  sgRNA
  Tmprss13_5
ggttgacctgaacctctcgg

SEQ ID NO: 62005 - DNA, 20 bp, Artificial Sequence
  sgRNA
  Tmprss13_6
atgacagctaccttacccca

SEQ ID NO: 62006 - DNA, 20 bp, Artificial Sequence
  sgRNA
  Tmprss13_7
atgtgtgccggggatctacg

SEQ ID NO: 62007 - DNA, 20 bp, Artificial Sequence
  sgRNA
  Tmprss13_8
aggatgacacacccgatgag

SEQ ID NO: 62008 - DNA, 20 bp, Artificial Sequence
  sgRNA
  Tmprss13_9
acttctggagaggccacaca

SEQ ID NO: 62009 - DNA, 20 bp, Artificial Sequence
  sgRNA
  Tmprss13_10
ctccatcacagcgaactgcg

SEQ ID NO: 62010 - DNA, 20 bp, Artificial Sequence
  sgRNA
  Tmprss13_11
gccaaagcccgtgatccaac

SEQ ID NO: 62011 - DNA, 20 bp, Artificial Sequence
  sgRNA
  Tmprss13_12
aacaaggtacactctcgttg

SEQ ID NO: 62012 - DNA, 20 bp, Artificial Sequence
  sgRNA
  Tmprss13_13
cccaaggatgatgtgtgccg

SEQ ID NO: 62013 - DNA, 20 bp, Artificial Sequence
  sgRNA
  Tmprss13_14
gctatgaccgggcggatcgt

SEQ ID NO: 62014 - DNA, 20 bp, Artificial Sequence
  sgRNA
  Tmprss13_15
tctgtgagcagaacaatcgc

SEQ ID NO: 62015 - DNA, 20 bp, Artificial Sequence
  sgRNA
  Tmprss13_16
gcacactcatcgatgcccag

SEQ ID NO: 62016 - DNA, 20 bp, Artificial Sequence
  sgRNA
  Tmprss13_17
ggaacgacactgactccaag

SEQ ID NO: 62017 - DNA, 20 bp, Artificial Sequence
  sgRNA
  Tmprss13_18
agcccgggcatctctagcca

SEQ ID NO: 62018 - DNA, 20 bp, Artificial Sequence
  sgRNA
  Tmprss13_19
gctgctggtgatgtccctgt

SEQ ID NO: 62019 - DNA, 20 bp, Artificial Sequence
  sgRNA
  Tmprss13_20
gtggtttgagagctatgacc

SEQ ID NO: 62020 - DNA, 20 bp, Artificial Sequence
  sgRNA
  Tmprss15_1
catatgtgtggtcaaaacgt

SEQ ID NO: 62021 - DNA, 20 bp, Artificial Sequence
  sgRNA
  Tmprss15_2
gctggcactctattgagaca

SEQ ID NO: 62022 - DNA, 20 bp, Artificial Sequence
  sgRNA
  Tmprss15_3
gccttggataacgatcagct

SEQ ID NO: 62023 - DNA, 20 bp, Artificial Sequence
  sgRNA
  Tmprss15_4
aacatggagaccagacgcaa

SEQ ID NO: 62024 - DNA, 20 bp, Artificial Sequence
  sgRNA
  Tmprss15_5
tcctcaagtagtaagacggg

SEQ ID NO: 62025 - DNA, 20 bp, Artificial Sequence
  sgRNA
  Tmprss15_6
atgccaatatcatctaccgg

SEQ ID NO: 62026 - DNA, 20 bp, Artificial Sequence
  sgRNA
  Tmprss15_7
gggtaacttatcaacaacag

SEQ ID NO: 62027 - DNA, 20 bp, Artificial Sequence
  sgRNA
  Tmprss15_8
ttctgcgtctgtcataatga

SEQ ID NO: 62028 - DNA, 20 bp, Artificial Sequence
  sgRNA
  Tmprss15_9
aggttgcagtacaatagccc

SEQ ID NO: 62029 - DNA, 20 bp, Artificial Sequence
  sgRNA
  Tmprss15_10
ccatatgtgtggtcaaaacg

SEQ ID NO: 62030 - DNA, 20 bp, Artificial Sequence
  sgRNA
  Tmprss15_11
tgcactgcctaatcaccctg

SEQ ID NO: 62031 - DNA, 20 bp, Artificial Sequence
  sgRNA
  Tmprss15_12
tgaaattcgtcatcttggca

SEQ ID NO: 62032 - DNA, 20 bp, Artificial Sequence
  sgRNA
  Tmprss15_13
gggctattgtactgcaacct

SEQ ID NO: 62033 - DNA, 20 bp, Artificial Sequence
  sgRNA
  Tmprss15_14
agactcggacatatacccca

SEQ ID NO: 62034 - DNA, 20 bp, Artificial Sequence
  sgRNA
  Tmprss15_15
atttctacaccaactgaaca

SEQ ID NO: 62035 - DNA, 20 bp, Artificial Sequence
  sgRNA
  Tmprss15_16
gtaaaagaagaactgattca

SEQ ID NO: 62036 - DNA, 20 bp, Artificial Sequence
  sgRNA
  Tmprss15_17
tgatacaaagccacaaccca

SEQ ID NO: 62037 - DNA, 20 bp, Artificial Sequence
  sgRNA
  Tmprss15_18
aatcaggtgttgtttgccga

SEQ ID NO: 62038 - DNA, 20 bp, Artificial Sequence
  sgRNA
  Tmprss15_19
aggactgctgtccatctggt

SEQ ID NO: 62039 - DNA, 20 bp, Artificial Sequence
  sgRNA
  Tmprss15_20
attatcatcatcaagatcct

SEQ ID NO: 62040 - DNA, 20 bp, Artificial Sequence
  sgRNA
  Tmprss5_1
ggtgctgtccgacaacacca

SEQ ID NO: 62041 - DNA, 20 bp, Artificial Sequence
  sgRNA
  Tmprss5_2
agagaaacaattcggccaga

SEQ ID NO: 62042 - DNA, 20 bp, Artificial Sequence
  sgRNA
  Tmprss5_3
agagagttgagcaaactcct

SEQ ID NO: 62043 - DNA, 20 bp, Artificial Sequence
  sgRNA
  Tmprss5_4
atctttcagaataaatggag

SEQ ID NO: 62044 - DNA, 20 bp, Artificial Sequence
  sgRNA
  Tmprss5_5
ccgtgcaccgaatctccatt

SEQ ID NO: 62045 - DNA, 20 bp, Artificial Sequence
  sgRNA
  Tmprss5_6
ggtgttgtcggacagcaccg

SEQ ID NO: 62046 - DNA, 20 bp, Artificial Sequence
  sgRNA
  Tmprss5_7
tcaccactgggacataccag

SEQ ID NO: 62047 - DNA, 20 bp, Artificial Sequence
  sgRNA
  Tmprss5_8
ggtagccagcacacaacatg

SEQ ID NO: 62048 - DNA, 20 bp, Artificial Sequence
  sgRNA
  Tmprss5_9
cgctggtgctgcctgcaacg

SEQ ID NO: 62049 - DNA, 20 bp, Artificial Sequence
  sgRNA
  Tmprss5_10
ggacccctggtatgtcccag

SEQ ID NO: 62050 - DNA, 20 bp, Artificial Sequence
  sgRNA
  Tmprss5_11
catcaagctcaacagatccc

SEQ ID NO: 62051 - DNA, 20 bp, Artificial Sequence
  sgRNA
  Tmprss5_12
gctcaactctctgctagacc

SEQ ID NO: 62052 - DNA, 20 bp, Artificial Sequence
  sgRNA
  Tmprss5_13
ctggcttctcgaatagttgg

SEQ ID NO: 62053 - DNA, 20 bp, Artificial Sequence
  sgRNA
  Tmprss5_14
tatgtcccagtggtgacacg

SEQ ID NO: 62054 - DNA, 20 bp, Artificial Sequence
  sgRNA
  Tmprss5_15
agatgtgcatgcccagggcg

SEQ ID NO: 62055 - DNA, 20 bp, Artificial Sequence
  sgRNA
  Tmprss5_16
gcagagccacatcatagtca

SEQ ID NO: 62056 - DNA, 20 bp, Artificial Sequence
  sgRNA
  Tmprss5_17
cagaggtaggtgctgagcag

SEQ ID NO: 62057 - DNA, 20 bp, Artificial Sequence
  sgRNA
  Tmprss5_18
actggatgaccaaagcccaa

SEQ ID NO: 62058 - DNA, 20 bp, Artificial Sequence
  sgRNA
  Tmprss5_19
aaggagcagcactttccatg

SEQ ID NO: 62059 - DNA, 20 bp, Artificial Sequence
  sgRNA
  Tmprss5_20
gctaccttggcatagacacc

SEQ ID NO: 62060 - DNA, 20 bp, Artificial Sequence
  sgRNA
  Tmprss6_1
ggttcgatgcctacgcactg

SEQ ID NO: 62061 - DNA, 20 bp, Artificial Sequence
  sgRNA
  Tmprss6_2
ggaaagcaatagactcccgt

SEQ ID NO: 62062 - DNA, 20 bp, Artificial Sequence
  sgRNA
  Tmprss6_3
aagacctcatgatcaaagtg

SEQ ID NO: 62063 - DNA, 20 bp, Artificial Sequence
  sgRNA
  Tmprss6_4
ccttgatcccgtcacacgca

SEQ ID NO: 62064 - DNA, 20 bp, Artificial Sequence
  sgRNA
  Tmprss6_5
gggcggccgttatgacccag

SEQ ID NO: 62065 - DNA, 20 bp, Artificial Sequence
  sgRNA
  Tmprss6_6
cagtggccgagtacaccacg

SEQ ID NO: 62066 - DNA, 20 bp, Artificial Sequence
  sgRNA
  Tmprss6_7
gctgcagctcgaccaccccg

SEQ ID NO: 62067 - DNA, 20 bp, Artificial Sequence
  sgRNA
  Tmprss6_8
gctctgtgctggctaccgca

SEQ ID NO: 62068 - DNA, 20 bp, Artificial Sequence
  sgRNA
  Tmprss6_9
ctgtacgtccaccttctgca

SEQ ID NO: 62069 - DNA, 20 bp, Artificial Sequence
  sgRNA
  Tmprss6_10
atatgctgagaggatcccca

SEQ ID NO: 62070 - DNA, 20 bp, Artificial Sequence
  sgRNA
  Tmprss6_11
cctcactgcagaggtcctga

SEQ ID NO: 62071 - DNA, 20 bp, Artificial Sequence
  sgRNA
  Tmprss6_12
aatgacggttgagcacccgg

SEQ ID NO: 62072 - DNA, 20 bp, Artificial Sequence
  sgRNA
  Tmprss6_13
gctcaaccgtcatttctccc

SEQ ID NO: 62073 - DNA, 20 bp, Artificial Sequence
  sgRNA
  Tmprss6_14
gttcctgcacccgtaccacg

SEQ ID NO: 62074 - DNA, 20 bp, Artificial Sequence
  sgRNA
  Tmprss6_15
gcagaaggtggacgtacagc

SEQ ID NO: 62075 - DNA, 20 bp, Artificial Sequence
  sgRNA
  Tmprss6_16
ggacagccatgactacgacg

SEQ ID NO: 62076 - DNA, 20 bp, Artificial Sequence
  sgRNA
  Tmprss6_17
agttgatcacacgtgtgaca

SEQ ID NO: 62077 - DNA, 20 bp, Artificial Sequence
  sgRNA
  Tmprss6_18
gccaagccgtagtccagaga

SEQ ID NO: 62078 - DNA, 20 bp, Artificial Sequence
  sgRNA
  Tmprss6_19
agtcgtactgaattccacgc

SEQ ID NO: 62079 - DNA, 20 bp, Artificial Sequence
  sgRNA
  Tmprss6_20
ggtgataagtctcttctcca

SEQ ID NO: 62080 - DNA, 20 bp, Artificial Sequence
  sgRNA
  Tmx3_1
gacttggcatataattaccg

SEQ ID NO: 62081 - DNA, 20 bp, Artificial Sequence
  sgRNA
  Tmx3_2
tgttcgaccatgtacggaag

SEQ ID NO: 62082 - DNA, 20 bp, Artificial Sequence
  sgRNA
  Tmx3_3
aagatggcgatctgtcctca

SEQ ID NO: 62083 - DNA, 20 bp, Artificial Sequence
  sgRNA
  Tmx3_4
gtgtggccattgtaaaaagt

SEQ ID NO: 62084 - DNA, 20 bp, Artificial Sequence
  sgRNA
  Tmx3_5
tatacagctgacacagatgg

SEQ ID NO: 62085 - DNA, 20 bp, Artificial Sequence
  sgRNA
  Tmx3_6
attatatcatctttagtccg

SEQ ID NO: 62086 - DNA, 20 bp, Artificial Sequence
  sgRNA
  Tmx3_7
tattaaggatgcgagcgaca

SEQ ID NO: 62087 - DNA, 20 bp, Artificial Sequence
  sgRNA
  Tmx3_8
cctcatggatcagcagagag

SEQ ID NO: 62088 - DNA, 20 bp, Artificial Sequence
  sgRNA
  Tmx3_9
gcttcagagtttggagttcg

SEQ ID NO: 62089 - DNA, 20 bp, Artificial Sequence
  sgRNA
  Tmx3_10
tattcagtacaactattgtt

SEQ ID NO: 62090 - DNA, 20 bp, Artificial Sequence
  sgRNA
  Tmx3_11
agcccaacttcattccaaat

SEQ ID NO: 62091 - DNA, 20 bp, Artificial Sequence
  sgRNA
  Tmx3_12
agcaagagtccagcagtgga

SEQ ID NO: 62092 - DNA, 20 bp, Artificial Sequence
  sgRNA
  Tmx3_13
ctgtgtctccaagttcatac

SEQ ID NO: 62093 - DNA, 20 bp, Artificial Sequence
  sgRNA
  Tmx3_14
atgatactgatgacacccag

SEQ ID NO: 62094 - DNA, 20 bp, Artificial Sequence
  sgRNA
  Tmx3_15
ttcaagagctctccacttat

SEQ ID NO: 62095 - DNA, 20 bp, Artificial Sequence
  sgRNA
  Tmx3_16
tatagtcatttccatccata

SEQ ID NO: 62096 - DNA, 20 bp, Artificial Sequence
  sgRNA
  Tmx3_17
attggttctccagttaaagt

SEQ ID NO: 62097 - DNA, 20 bp, Artificial Sequence
  sgRNA
  Tmx3_18
aaagagcaagagtccagcag

SEQ ID NO: 62098 - DNA, 20 bp, Artificial Sequence
  sgRNA
  Tmx3_19
catataattaccgaggacca

SEQ ID NO: 62099 - DNA, 20 bp, Artificial Sequence
  sgRNA
  Tmx3_20
aaaagaaagcagcccataag

SEQ ID NO: 62100 - DNA, 20 bp, Artificial Sequence
  sgRNA
  Tmx4_1
actgataacttacgttagag

SEQ ID NO: 62101 - DNA, 20 bp, Artificial Sequence
  sgRNA
  Tmx4_2
agaaacacttcagatcagtg

SEQ ID NO: 62102 - DNA, 20 bp, Artificial Sequence
  sgRNA
  Tmx4_3
gaacaggccaaacaccaatg

SEQ ID NO: 62103 - DNA, 20 bp, Artificial Sequence
  sgRNA
  Tmx4_4
gggatattccgccgttaccg

SEQ ID NO: 62104 - DNA, 20 bp, Artificial Sequence
  sgRNA
  Tmx4_5
ttcctggaccacggtaacgg

SEQ ID NO: 62105 - DNA, 20 bp, Artificial Sequence
  sgRNA
  Tmx4_6
tgacccttggaattcctgca

SEQ ID NO: 62106 - DNA, 20 bp, Artificial Sequence
  sgRNA
  Tmx4_7
gcaggagcagagtactggag

SEQ ID NO: 62107 - DNA, 20 bp, Artificial Sequence
  sgRNA
  Tmx4_8
aagagtcagaatgccaacaa

SEQ ID NO: 62108 - DNA, 20 bp, Artificial Sequence
  sgRNA
  Tmx4_9
agcccatgaccgcctccaac

SEQ ID NO: 62109 - DNA, 20 bp, Artificial Sequence
  sgRNA
  Tmx4_10
aactggacgctggtgatgga

SEQ ID NO: 62110 - DNA, 20 bp, Artificial Sequence
  sgRNA
  Tmx4_11
gccagcagactgattctgaa

SEQ ID NO: 62111 - DNA, 20 bp, Artificial Sequence
  sgRNA
  Tmx4_12
cttcatagattcctggacca

SEQ ID NO: 62112 - DNA, 20 bp, Artificial Sequence
  sgRNA
  Tmx4_13
ttcagaatcagtctgctggc

SEQ ID NO: 62113 - DNA, 20 bp, Artificial Sequence
  sgRNA
  Tmx4_14
gggtagtgtgtccccaaagg

SEQ ID NO: 62114 - DNA, 20 bp, Artificial Sequence
  sgRNA
  Tmx4_15
acaccatgcaggaattccaa

SEQ ID NO: 62115 - DNA, 20 bp, Artificial Sequence
  sgRNA
  Tmx4_16
gagcgagcagttgtgaagga

SEQ ID NO: 62116 - DNA, 20 bp, Artificial Sequence
  sgRNA
  Tmx4_17
tgtaaatgtggtctatagat

SEQ ID NO: 62117 - DNA, 20 bp, Artificial Sequence
  sgRNA
  Tmx4_18
agtgtgtccccaaaggagga

SEQ ID NO: 62118 - DNA, 20 bp, Artificial Sequence
  sgRNA
  Tmx4_19
cttcacaactgctcgctcgt

SEQ ID NO: 62119 - DNA, 20 bp, Artificial Sequence
  sgRNA
  Tmx4_20
ggtgagctccgtcctccttt

SEQ ID NO: 62120 - DNA, 20 bp, Artificial Sequence
  sgRNA
  Tnfrsf11a_1
accagcacaacggtcccctg

SEQ ID NO: 62121 - DNA, 20 bp, Artificial Sequence
  sgRNA
  Tnfrsf11a_2
acactgaggagaccacccaa

SEQ ID NO: 62122 - DNA, 20 bp, Artificial Sequence
  sgRNA
  Tnfrsf11a_3
gtttaagccagtgtttcacc

SEQ ID NO: 62123 - DNA, 20 bp, Artificial Sequence
  sgRNA
  Tnfrsf11a_4
agacgcaaggagacctctcg

SEQ ID NO: 62124 - DNA, 20 bp, Artificial Sequence
  sgRNA
  Tnfrsf11a_5
cgtgcaagcacagcgacgcg

SEQ ID NO: 62125 - DNA, 20 bp, Artificial Sequence
  sgRNA
  Tnfrsf11a_6
ggaaagctagaagcacacca

SEQ ID NO: 62126 - DNA, 20 bp, Artificial Sequence
  sgRNA
  Tnfrsf11a_7
ggcattatgagcatctcgga

SEQ ID NO: 62127 - DNA, 20 bp, Artificial Sequence
  sgRNA
  Tnfrsf11a_8
gatgtcccgtccttctgccg

SEQ ID NO: 62128 - DNA, 20 bp, Artificial Sequence
  sgRNA
  Tnfrsf11a_9
aagtactcatcggggccaca

SEQ ID NO: 62129 - DNA, 20 bp, Artificial Sequence
  sgRNA
  Tnfrsf11a_10
agacttcactccatacccag

SEQ ID NO: 62130 - DNA, 20 bp, Artificial Sequence
  sgRNA
  Tnfrsf11a_11
ggtcactcctccatgcaccc

SEQ ID NO: 62131 - DNA, 20 bp, Artificial Sequence
  sgRNA
  Tnfrsf11a_12
aggaccatgaaccctttcca

SEQ ID NO: 62132 - DNA, 20 bp, Artificial Sequence
  sgRNA
  Tnfrsf11a_13
tcactgctcctaatccagca

SEQ ID NO: 62133 - DNA, 20 bp, Artificial Sequence
  sgRNA
  Tnfrsf11a_14
cagacttcactccataccca

SEQ ID NO: 62134 - DNA, 20 bp, Artificial Sequence
  sgRNA
  Tnfrsf11a_15
atagagtcagttctgctcgg

SEQ ID NO: 62135 - DNA, 20 bp, Artificial Sequence
  sgRNA
  Tnfrsf11a_16
ccaggtgtccaagtactcat

SEQ ID NO: 62136 - DNA, 20 bp, Artificial Sequence
  sgRNA
  Tnfrsf11a_17
aggtgtccaagtactcatcg

SEQ ID NO: 62137 - DNA, 20 bp, Artificial Sequence
  sgRNA
  Tnfrsf11a_18
gatgcttgcagtagtctaag

SEQ ID NO: 62138 - DNA, 20 bp, Artificial Sequence
  sgRNA
  Tnfrsf11a_19
ctgcccgctagagatgaacg

SEQ ID NO: 62139 - DNA, 20 bp, Artificial Sequence
  sgRNA
  Tnfrsf11a_20
gcagacttcactccataccc

SEQ ID NO: 62140 - DNA, 20 bp, Artificial Sequence
  sgRNA
  Tnfrsf13b_1
gtactacgaccatctcctgg

SEQ ID NO: 62141 - DNA, 20 bp, Artificial Sequence
  sgRNA
  Tnfrsf13b_2
gaagtcaggtcagacaactc

SEQ ID NO: 62142 - DNA, 20 bp, Artificial Sequence
  sgRNA
  Tnfrsf13b_3
gtggctctcctctacgcctg

SEQ ID NO: 62143 - DNA, 20 bp, Artificial Sequence
  sgRNA
  Tnfrsf13b_4
atcagtactgggactcctca

SEQ ID NO: 62144 - DNA, 20 bp, Artificial Sequence
  sgRNA
  Tnfrsf13b_5
ccgtgtatcccgagcgaacg

SEQ ID NO: 62145 - DNA, 20 bp, Artificial Sequence
  sgRNA
  Tnfrsf13b_6
tgtatgcgtgcaacagtagg

SEQ ID NO: 62146 - DNA, 20 bp, Artificial Sequence
  sgRNA
  Tnfrsf13b_7
cctactgttgcacgcataca

SEQ ID NO: 62147 - DNA, 20 bp, Artificial Sequence
  sgRNA
  Tnfrsf13b_8
tgtcctgcgcgcatccactg

SEQ ID NO: 62148 - DNA, 20 bp, Artificial Sequence
  sgRNA
  Tnfrsf13b_9
tgccggacgagcgtccccag

SEQ ID NO: 62149 - DNA, 20 bp, Artificial Sequence
  sgRNA
  Tnfrsf13b_10
agtcccagtactgatctttg

SEQ ID NO: 62150 - DNA, 20 bp, Artificial Sequence
  sgRNA
  Tnfrsf13b_11
ccgcgttcgctcgggataca

SEQ ID NO: 62151 - DNA, 20 bp, Artificial Sequence
  sgRNA
  Tnfrsf13b_12
cagaagctacacgtttccac

SEQ ID NO: 62152 - DNA, 20 bp, Artificial Sequence
  sgRNA
  Tnfrsf13b_13
gttgcacgcatacagggctg

SEQ ID NO: 62153 - DNA, 20 bp, Artificial Sequence
  sgRNA
  Tnfrsf13b_14
cgtcgcaagcctctgtcacg

SEQ ID NO: 62154 - DNA, 20 bp, Artificial Sequence
  sgRNA
  Tnfrsf13b_15
gcctccttcctcaggcgtag

SEQ ID NO: 62155 - DNA, 20 bp, Artificial Sequence
  sgRNA
  Tnfrsf13b_16
gagtttgcttgtgacccacg

SEQ ID NO: 62156 - DNA, 20 bp, Artificial Sequence
  sgRNA
  Tnfrsf13b_17
tcaggtcagacaactcagga

SEQ ID NO: 62157 - DNA, 20 bp, Artificial Sequence
  sgRNA
  Tnfrsf13b_18
tgcacgcatacagggctgcg

SEQ ID NO: 62158 - DNA, 20 bp, Artificial Sequence
  sgRNA
  Tnfrsf13b_19
gctcgggatacacggcttcg

SEQ ID NO: 62159 - DNA, 20 bp, Artificial Sequence
  sgRNA
  Tnfrsf13b_20
ggtggagtcacagctgacgc

SEQ ID NO: 62160 - DNA, 20 bp, Artificial Sequence
  sgRNA
  Tnfrsf14_1
tgggcggtatatgtctgtgg

SEQ ID NO: 62161 - DNA, 20 bp, Artificial Sequence
  sgRNA
  Tnfrsf14_2
tatgtgctgactgcctaaca

SEQ ID NO: 62162 - DNA, 20 bp, Artificial Sequence
  sgRNA
  Tnfrsf14_3
cctggatcacagactccgca

SEQ ID NO: 62163 - DNA, 20 bp, Artificial Sequence
  sgRNA
  Tnfrsf14_4
gccccatgtgcaacccaggt

SEQ ID NO: 62164 - DNA, 20 bp, Artificial Sequence
  sgRNA
  Tnfrsf14_5
ggtctcagcaaacccaacct

SEQ ID NO: 62165 - DNA, 20 bp, Artificial Sequence
  sgRNA
  Tnfrsf14_6
aacgtagtagacgacctggg

SEQ ID NO: 62166 - DNA, 20 bp, Artificial Sequence
  sgRNA
  Tnfrsf14_7
catcaggtttccagtcaccg

SEQ ID NO: 62167 - DNA, 20 bp, Artificial Sequence
  sgRNA
  Tnfrsf14_8
gctcaggccatttgcatggg

SEQ ID NO: 62168 - DNA, 20 bp, Artificial Sequence
  sgRNA
  Tnfrsf14_9
ccagccctcatgcagacagg

SEQ ID NO: 62169 - DNA, 20 bp, Artificial Sequence
  sgRNA
  Tnfrsf14_10
tttcaacaggaagtaagacg

SEQ ID NO: 62170 - DNA, 20 bp, Artificial Sequence
  sgRNA
  Tnfrsf14_11
acagggaccttctcacttgg

SEQ ID NO: 62171 - DNA, 20 bp, Artificial Sequence
  sgRNA
  Tnfrsf14_12
ggtttccagtcaccgaggtt

SEQ ID NO: 62172 - DNA, 20 bp, Artificial Sequence
  sgRNA
  Tnfrsf14_13
gcaggagtgctccagctgga

SEQ ID NO: 62173 - DNA, 20 bp, Artificial Sequence
  sgRNA
  Tnfrsf14_14
ctcggtgactggaaacctga

SEQ ID NO: 62174 - DNA, 20 bp, Artificial Sequence
  sgRNA
  Tnfrsf14_15
cagacaggaggagttccttg

SEQ ID NO: 62175 - DNA, 20 bp, Artificial Sequence
  sgRNA
  Tnfrsf14_16
acttctgtgagaaccaggat

SEQ ID NO: 62176 - DNA, 20 bp, Artificial Sequence
  sgRNA
  Tnfrsf14_17
gtatgtgctgactgcctaac

SEQ ID NO: 62177 - DNA, 20 bp, Artificial Sequence
  sgRNA
  Tnfrsf14_18
tacagacaacaccttcaggc

SEQ ID NO: 62178 - DNA, 20 bp, Artificial Sequence
  sgRNA
  Tnfrsf14_19
ggttgggtttgctgagaccg

SEQ ID NO: 62179 - DNA, 20 bp, Artificial Sequence
  sgRNA
  Tnfrsf14_20
ggttctcacagaagtagcct

SEQ ID NO: 62180 - DNA, 20 bp, Artificial Sequence
  sgRNA
  Tnfrsf17_1
ttcagtgaaagggacgtaca

SEQ ID NO: 62181 - DNA, 20 bp, Artificial Sequence
  sgRNA
  Tnfrsf17_2
gctgaggaagatgaaccccg

SEQ ID NO: 62182 - DNA, 20 bp, Artificial Sequence
  sgRNA
  Tnfrsf17_3
actgtatactccaggcttcg

SEQ ID NO: 62183 - DNA, 20 bp, Artificial Sequence
  sgRNA
  Tnfrsf17_4
gagctgactaggatcagggc

SEQ ID NO: 62184 - DNA, 20 bp, Artificial Sequence
  sgRNA
  Tnfrsf17_5
gtgtcaagagcaaacccaag

SEQ ID NO: 62185 - DNA, 20 bp, Artificial Sequence
  sgRNA
  Tnfrsf17_6
tgtcaagagcaaacccaagg

SEQ ID NO: 62186 - DNA, 20 bp, Artificial Sequence
  sgRNA
  Tnfrsf17_7
aaatggtcagaatccccctt

SEQ ID NO: 62187 - DNA, 20 bp, Artificial Sequence
  sgRNA
  Tnfrsf17_8
gcgtgaccagttcagtgaaa

SEQ ID NO: 62188 - DNA, 20 bp, Artificial Sequence
  sgRNA
  Tnfrsf17_9
tgtgtcaagagcaaacccaa

SEQ ID NO: 62189 - DNA, 20 bp, Artificial Sequence
  sgRNA
  Tnfrsf17_10
ccgaagcctggagtatacag

SEQ ID NO: 62190 - DNA, 20 bp, Artificial Sequence
  sgRNA
  Tnfrsf17_11
caaagcccaggtcagcttga

SEQ ID NO: 62191 - DNA, 20 bp, Artificial Sequence
  sgRNA
  Tnfrsf17_12
agccctgatcctagtcagct

SEQ ID NO: 62192 - DNA, 20 bp, Artificial Sequence
  sgRNA
  Tnfrsf17_13
ttgtgaaaagtgccaaagag

SEQ ID NO: 62193 - DNA, 20 bp, Artificial Sequence
  sgRNA
  Tnfrsf17_14
gatcctagtcagctcggtgt

SEQ ID NO: 62194 - DNA, 20 bp, Artificial Sequence
  sgRNA
  Tnfrsf17_15
gctcgtccttcagggcctcg

SEQ ID NO: 62195 - DNA, 20 bp, Artificial Sequence
  sgRNA
  Tnfrsf17_16
ctgctttgcaaagtgtcatg

SEQ ID NO: 62196 - DNA, 20 bp, Artificial Sequence
  sgRNA
  Tnfrsf17_17
aaggctgacaggttgcagga

SEQ ID NO: 62197 - DNA, 20 bp, Artificial Sequence
  sgRNA
  Tnfrsf17_18
gctcttgacacagtcctcac

SEQ ID NO: 62198 - DNA, 20 bp, Artificial Sequence
  sgRNA
  Tnfrsf17_19
ctgtgtcaagagcaaaccca

SEQ ID NO: 62199 - DNA, 20 bp, Artificial Sequence
  sgRNA
  Tnfrsf17_20
gtacgtccctttcactgaac

SEQ ID NO: 62200 - DNA, 20 bp, Artificial Sequence
  sgRNA
  Tnfrsf18_1
gccaaacacaatatcccctg

SEQ ID NO: 62201 - DNA, 20 bp, Artificial Sequence
  sgRNA
  Tnfrsf18_2
gtcacacctgagtaccactg

SEQ ID NO: 62202 - DNA, 20 bp, Artificial Sequence
  sgRNA
  Tnfrsf18_3
gcagtgaccgtcacgacctg

SEQ ID NO: 62203 - DNA, 20 bp, Artificial Sequence
  sgRNA
  Tnfrsf18_4
ttattcttgtccaggcaagg

SEQ ID NO: 62204 - DNA, 20 bp, Artificial Sequence
  sgRNA
  Tnfrsf18_5
agagacccagccattcgcgg

SEQ ID NO: 62205 - DNA, 20 bp, Artificial Sequence
  sgRNA
  Tnfrsf18_6
gttccctgaggaggaacgcg

SEQ ID NO: 62206 - DNA, 20 bp, Artificial Sequence
  sgRNA
  Tnfrsf18_7
ttccgttctgaaccttgcca

SEQ ID NO: 62207 - DNA, 20 bp, Artificial Sequence
  sgRNA
  Tnfrsf18_8
tcgaggtcagttgtgtccca

SEQ ID NO: 62208 - DNA, 20 bp, Artificial Sequence
  sgRNA
  Tnfrsf18_9
tgagttacgattgggcccta

SEQ ID NO: 62209 - DNA, 20 bp, Artificial Sequence
  sgRNA
  Tnfrsf18_10
gagagcggtgagttacgatt

SEQ ID NO: 62210 - DNA, 20 bp, Artificial Sequence
  sgRNA
  Tnfrsf18_11
ctctgtagtaaaactgcgtg

SEQ ID NO: 62211 - DNA, 20 bp, Artificial Sequence
  sgRNA
  Tnfrsf18_12
ccctctggcctggttggcag

SEQ ID NO: 62212 - DNA, 20 bp, Artificial Sequence
  sgRNA
  Tnfrsf18_13
gcttgcagatcttgcactga

SEQ ID NO: 62213 - DNA, 20 bp, Artificial Sequence
  sgRNA
  Tnfrsf18_14
agttccctgaggaggaacgc

SEQ ID NO: 62214 - DNA, 20 bp, Artificial Sequence
  sgRNA
  Tnfrsf18_15
gctccccgcgttcctcctca

SEQ ID NO: 62215 - DNA, 20 bp, Artificial Sequence
  sgRNA
  Tnfrsf18_16
ttgcagcttccagttccctg

SEQ ID NO: 62216 - DNA, 20 bp, Artificial Sequence
  sgRNA
  Tnfrsf18_17
catcgagactccatacagca

SEQ ID NO: 62217 - DNA, 20 bp, Artificial Sequence
  sgRNA
  Tnfrsf18_18
ggatttctcaccatgttccc

SEQ ID NO: 62218 - DNA, 20 bp, Artificial Sequence
  sgRNA
  Tnfrsf18_19
tatacccttggtgagagcag

SEQ ID NO: 62219 - DNA, 20 bp, Artificial Sequence
  sgRNA
  Tnfrsf18_20
gccatgggcaccttctccgc

SEQ ID NO: 62220 - DNA, 20 bp, Artificial Sequence
  sgRNA
  Tnfrsf19_1
caccggttcaaggaagactg

SEQ ID NO: 62221 - DNA, 20 bp, Artificial Sequence
  sgRNA
  Tnfrsf19_2
agggatgggagcttacagct

SEQ ID NO: 62222 - DNA, 20 bp, Artificial Sequence
  sgRNA
  Tnfrsf19_3
cggtggaggagatcttcaca

SEQ ID NO: 62223 - DNA, 20 bp, Artificial Sequence
  sgRNA
  Tnfrsf19_4
agcatgctgtcagtatcacc

SEQ ID NO: 62224 - DNA, 20 bp, Artificial Sequence
  sgRNA
  Tnfrsf19_5
gctggtgaaccgctttcaga

SEQ ID NO: 62225 - DNA, 20 bp, Artificial Sequence
  sgRNA
  Tnfrsf19_6
aagagcaccgtcctgtgtag

SEQ ID NO: 62226 - DNA, 20 bp, Artificial Sequence
  sgRNA
  Tnfrsf19_7
ccagaagtgtaagccatgtg

SEQ ID NO: 62227 - DNA, 20 bp, Artificial Sequence
  sgRNA
  Tnfrsf19_8
tcaaggtcctacctctacac

SEQ ID NO: 62228 - DNA, 20 bp, Artificial Sequence
  sgRNA
  Tnfrsf19_9
tgtcatgctttgaccagcct

SEQ ID NO: 62229 - DNA, 20 bp, Artificial Sequence
  sgRNA
  Tnfrsf19_10
gacatggagtgtgtgccctg

SEQ ID NO: 62230 - DNA, 20 bp, Artificial Sequence
  sgRNA
  Tnfrsf19_11
gcctcttcacagcacaagga

SEQ ID NO: 62231 - DNA, 20 bp, Artificial Sequence
  sgRNA
  Tnfrsf19_12
gtaccagtgtcaccatgtct

SEQ ID NO: 62232 - DNA, 20 bp, Artificial Sequence
  sgRNA
  Tnfrsf19_13
agagagctgtcaccacccag

SEQ ID NO: 62233 - DNA, 20 bp, Artificial Sequence
  sgRNA
  Tnfrsf19_14
gcatctctggattccagtgg

SEQ ID NO: 62234 - DNA, 20 bp, Artificial Sequence
  sgRNA
  Tnfrsf19_15
gtatcttctccagtgagttc

SEQ ID NO: 62235 - DNA, 20 bp, Artificial Sequence
  sgRNA
  Tnfrsf19_16
tcgtgtcccccacagaagcc

SEQ ID NO: 62236 - DNA, 20 bp, Artificial Sequence
  sgRNA
  Tnfrsf19_17
tgggcacagtggcggagccg

SEQ ID NO: 62237 - DNA, 20 bp, Artificial Sequence
  sgRNA
  Tnfrsf19_18
ggtcctacctctacacagga

SEQ ID NO: 62238 - DNA, 20 bp, Artificial Sequence
  sgRNA
  Tnfrsf19_19
taccggaagaccaaactggt

SEQ ID NO: 62239 - DNA, 20 bp, Artificial Sequence
  sgRNA
  Tnfrsf19_20
catctgcagtgctctggcca

SEQ ID NO: 62240 - DNA, 20 bp, Artificial Sequence
  sgRNA
  Tnfrsf1a_1
agttgcaagacatgtcggaa

SEQ ID NO: 62241 - DNA, 20 bp, Artificial Sequence
  sgRNA
  Tnfrsf1a_2
agacctagcaagataaccag

SEQ ID NO: 62242 - DNA, 20 bp, Artificial Sequence
  sgRNA
  Tnfrsf1a_3
gatggggatacatccatcag

SEQ ID NO: 62243 - DNA, 20 bp, Artificial Sequence
  sgRNA
  Tnfrsf1a_4
ggatcccgtgcctgtcaaag

SEQ ID NO: 62244 - DNA, 20 bp, Artificial Sequence
  sgRNA
  Tnfrsf1a_5
gggtttgtgacatttgcaag

SEQ ID NO: 62245 - DNA, 20 bp, Artificial Sequence
  sgRNA
  Tnfrsf1a_6
gtagacttcgggcctccacc

SEQ ID NO: 62246 - DNA, 20 bp, Artificial Sequence
  sgRNA
  Tnfrsf1a_7
tgctgtactgagcctcgcgc

SEQ ID NO: 62247 - DNA, 20 bp, Artificial Sequence
  sgRNA
  Tnfrsf1a_8
agtgaggtagtcccaaccca

SEQ ID NO: 62248 - DNA, 20 bp, Artificial Sequence
  sgRNA
  Tnfrsf1a_9
tccagcgtgtcctcgtggcg

SEQ ID NO: 62249 - DNA, 20 bp, Artificial Sequence
  sgRNA
  Tnfrsf1a_10
acagcatgctggaagcctgg

SEQ ID NO: 62250 - DNA, 20 bp, Artificial Sequence
  sgRNA
  Tnfrsf1a_11
tgcaaatgtcacaaaccccc

SEQ ID NO: 62251 - DNA, 20 bp, Artificial Sequence
  sgRNA
  Tnfrsf1a_12
gtttaatgtgccgatatccc

SEQ ID NO: 62252 - DNA, 20 bp, Artificial Sequence
  sgRNA
  Tnfrsf1a_13
tgagtgactgtccgagccca

SEQ ID NO: 62253 - DNA, 20 bp, Artificial Sequence
  sgRNA
  Tnfrsf1a_14
aagacctagcaagataacca

SEQ ID NO: 62254 - DNA, 20 bp, Artificial Sequence
  sgRNA
  Tnfrsf1a_15
gtgcctggagaatatcctcg

SEQ ID NO: 62255 - DNA, 20 bp, Artificial Sequence
  sgRNA
  Tnfrsf1a_16
gcaaggagagatctccacct

SEQ ID NO: 62256 - DNA, 20 bp, Artificial Sequence
  sgRNA
  Tnfrsf1a_17
gaatggacatactttccttg

SEQ ID NO: 62257 - DNA, 20 bp, Artificial Sequence
  sgRNA
  Tnfrsf1a_18
gttgggactacctcactgac

SEQ ID NO: 62258 - DNA, 20 bp, Artificial Sequence
  sgRNA
  Tnfrsf1a_19
ggttcatcttggaaagcacg

SEQ ID NO: 62259 - DNA, 20 bp, Artificial Sequence
  sgRNA
  Tnfrsf1a_20
tagacttcgggcctccaccg

SEQ ID NO: 62260 - DNA, 20 bp, Artificial Sequence
  sgRNA
  Tnfrsf1b_1
aggaagtcaacactcacatg

SEQ ID NO: 62261 - DNA, 20 bp, Artificial Sequence
  sgRNA
  Tnfrsf1b_2
tgaggcaagcatgtataccc

SEQ ID NO: 62262 - DNA, 20 bp, Artificial Sequence
  sgRNA
  Tnfrsf1b_3
tgtagggtgtcaagacaacc

SEQ ID NO: 62263 - DNA, 20 bp, Artificial Sequence
  sgRNA
  Tnfrsf1b_4
gcccacaagatcccaacccc

SEQ ID NO: 62264 - DNA, 20 bp, Artificial Sequence
  sgRNA
  Tnfrsf1b_5
ggtactttgttcaataatgg

SEQ ID NO: 62265 - DNA, 20 bp, Artificial Sequence
  sgRNA
  Tnfrsf1b_6
gattcttcccacggaagcca

SEQ ID NO: 62266 - DNA, 20 bp, Artificial Sequence
  sgRNA
  Tnfrsf1b_7
gcccatatccggcacaccaa

SEQ ID NO: 62267 - DNA, 20 bp, Artificial Sequence
  sgRNA
  Tnfrsf1b_8
ccaagcatccttacatcgtt

SEQ ID NO: 62268 - DNA, 20 bp, Artificial Sequence
  sgRNA
  Tnfrsf1b_9
gtacgagtgccagatctcac

SEQ ID NO: 62269 - DNA, 20 bp, Artificial Sequence
  sgRNA
  Tnfrsf1b_10
gtccgcacacacggtgtccg

SEQ ID NO: 62270 - DNA, 20 bp, Artificial Sequence
  sgRNA
  Tnfrsf1b_11
agcgctggctgagctctcta

SEQ ID NO: 62271 - DNA, 20 bp, Artificial Sequence
  sgRNA
  Tnfrsf1b_12
gcagctgtcgacagtgcatg

SEQ ID NO: 62272 - DNA, 20 bp, Artificial Sequence
  sgRNA
  Tnfrsf1b_13
cattattgaacaaagtacca

SEQ ID NO: 62273 - DNA, 20 bp, Artificial Sequence
  sgRNA
  Tnfrsf1b_14
gagatacgtagagtgtcctt

SEQ ID NO: 62274 - DNA, 20 bp, Artificial Sequence
  sgRNA
  Tnfrsf1b_15
ggtggcatctctcttccaat

SEQ ID NO: 62275 - DNA, 20 bp, Artificial Sequence
  sgRNA
  Tnfrsf1b_16
gatgcaggtgacgttgacgt

SEQ ID NO: 62276 - DNA, 20 bp, Artificial Sequence
  sgRNA
  Tnfrsf1b_17
gaagaccagcgcgacccaga

SEQ ID NO: 62277 - DNA, 20 bp, Artificial Sequence
  sgRNA
  Tnfrsf1b_18
gtgtctctgtagtctcacac

SEQ ID NO: 62278 - DNA, 20 bp, Artificial Sequence
  sgRNA
  Tnfrsf1b_19
gggtctgctgatgttaggac

SEQ ID NO: 62279 - DNA, 20 bp, Artificial Sequence
  sgRNA
  Tnfrsf1b_20
acgaaactggttccagacct

SEQ ID NO: 62280 - DNA, 20 bp, Artificial Sequence
  sgRNA
  Tnfrsf21_1
gcctggtaaaggtccccgcg

SEQ ID NO: 62281 - DNA, 20 bp, Artificial Sequence
  sgRNA
  Tnfrsf21_2
aaggagacagacaacgtctg

SEQ ID NO: 62282 - DNA, 20 bp, Artificial Sequence
  sgRNA
  Tnfrsf21_3
acaatacgagctcaaccagt

SEQ ID NO: 62283 - DNA, 20 bp, Artificial Sequence
  sgRNA
  Tnfrsf21_4
gatgcactctcggtcagtca

SEQ ID NO: 62284 - DNA, 20 bp, Artificial Sequence
  sgRNA
  Tnfrsf21_5
gctgcatatcctgaaccccg

SEQ ID NO: 62285 - DNA, 20 bp, Artificial Sequence
  sgRNA
  Tnfrsf21_6
agatcatgaacgggcctacg

SEQ ID NO: 62286 - DNA, 20 bp, Artificial Sequence
  sgRNA
  Tnfrsf21_7
ggtacggtcaacatggcggt

SEQ ID NO: 62287 - DNA, 20 bp, Artificial Sequence
  sgRNA
  Tnfrsf21_8
attagtgccttccttcccac

SEQ ID NO: 62288 - DNA, 20 bp, Artificial Sequence
  sgRNA
  Tnfrsf21_9
tctccacaacatcattgcgt

SEQ ID NO: 62289 - DNA, 20 bp, Artificial Sequence
  sgRNA
  Tnfrsf21_10
tgaccccaatgatctcgaag

SEQ ID NO: 62290 - DNA, 20 bp, Artificial Sequence
  sgRNA
  Tnfrsf21_11
gcgccatagtggaaaaggcg

SEQ ID NO: 62291 - DNA, 20 bp, Artificial Sequence
  sgRNA
  Tnfrsf21_12
acatcaacgagcacttgcct

SEQ ID NO: 62292 - DNA, 20 bp, Artificial Sequence
  sgRNA
  Tnfrsf21_13
agtctgcagcagctgccccg

SEQ ID NO: 62293 - DNA, 20 bp, Artificial Sequence
  sgRNA
  Tnfrsf21_14
tgtggagtcgcatcgcagaa

SEQ ID NO: 62294 - DNA, 20 bp, Artificial Sequence
  sgRNA
  Tnfrsf21_15
gatgaagtgtaaagctcaca

SEQ ID NO: 62295 - DNA, 20 bp, Artificial Sequence
  sgRNA
  Tnfrsf21_16
gtcccttcctcgatgccact

SEQ ID NO: 62296 - DNA, 20 bp, Artificial Sequence
  sgRNA
  Tnfrsf21_17
gttagaactaaggtaccaag

SEQ ID NO: 62297 - DNA, 20 bp, Artificial Sequence
  sgRNA
  Tnfrsf21_18
gcagactcgcaggctcatgt

SEQ ID NO: 62298 - DNA, 20 bp, Artificial Sequence
  sgRNA
  Tnfrsf21_19
gctggggtgtgcggaagaaa

SEQ ID NO: 62299 - DNA, 20 bp, Artificial Sequence
  sgRNA
  Tnfrsf21_20
aagcacttgttcttgtccag

SEQ ID NO: 62300 - DNA, 20 bp, Artificial Sequence
  sgRNA
  Tnfrsf22_1
agcaaagtatacaagcatcc

SEQ ID NO: 62301 - DNA, 20 bp, Artificial Sequence
  sgRNA
  Tnfrsf22_2
tttagaccagtattcaccag

SEQ ID NO: 62302 - DNA, 20 bp, Artificial Sequence
  sgRNA
  Tnfrsf22_3
tgagtatgggggatttcgca

SEQ ID NO: 62303 - DNA, 20 bp, Artificial Sequence
  sgRNA
  Tnfrsf22_4
gattgcagatcaggaaatgg

SEQ ID NO: 62304 - DNA, 20 bp, Artificial Sequence
  sgRNA
  Tnfrsf22_5
tatgatacggaagacaacaa

SEQ ID NO: 62305 - DNA, 20 bp, Artificial Sequence
  sgRNA
  Tnfrsf22_6
ttagaccagtattcaccagc

SEQ ID NO: 62306 - DNA, 20 bp, Artificial Sequence
  sgRNA
  Tnfrsf22_7
cactccttcaaatgtcccgc

SEQ ID NO: 62307 - DNA, 20 bp, Artificial Sequence
  sgRNA
  Tnfrsf22_8
actgctcagccaccagtgac

SEQ ID NO: 62308 - DNA, 20 bp, Artificial Sequence
  sgRNA
  Tnfrsf22_9
gtcgctggttcctttggcgg

SEQ ID NO: 62309 - DNA, 20 bp, Artificial Sequence
  sgRNA
  Tnfrsf22_10
gccaggtcggacttggtgag

SEQ ID NO: 62310 - DNA, 20 bp, Artificial Sequence
  sgRNA
  Tnfrsf22_11
aatgtcccgctggtgaatac

SEQ ID NO: 62311 - DNA, 20 bp, Artificial Sequence
  sgRNA
  Tnfrsf22_12
agtaaagacctgttcggcac

SEQ ID NO: 62312 - DNA, 20 bp, Artificial Sequence
  sgRNA
  Tnfrsf22_13
gacacaattagcacactcaa

SEQ ID NO: 62313 - DNA, 20 bp, Artificial Sequence
  sgRNA
  Tnfrsf22_14
gtgataacagtaggaacagc

SEQ ID NO: 62314 - DNA, 20 bp, Artificial Sequence
  sgRNA
  Tnfrsf22_15
cactcaaaggtgataacagt

SEQ ID NO: 62315 - DNA, 20 bp, Artificial Sequence
  sgRNA
  Tnfrsf22_16
ttgagtatgggggatttcgc

SEQ ID NO: 62316 - DNA, 20 bp, Artificial Sequence
  sgRNA
  Tnfrsf22_17
ctttctctgtgaatgttcct

SEQ ID NO: 62317 - DNA, 20 bp, Artificial Sequence
  sgRNA
  Tnfrsf22_18
catagtagtaaagacctgtt

SEQ ID NO: 62318 - DNA, 20 bp, Artificial Sequence
  sgRNA
  Tnfrsf22_19
ggatacgatgaccccttctg

SEQ ID NO: 62319 - DNA, 20 bp, Artificial Sequence
  sgRNA
  Tnfrsf22_20
cacagagaaagataattacc

SEQ ID NO: 62320 - DNA, 20 bp, Artificial Sequence
  sgRNA
  Tnfrsf23_1
gtcacccaggaacattcaca

SEQ ID NO: 62321 - DNA, 20 bp, Artificial Sequence
  sgRNA
  Tnfrsf23_2
attagactggtattcaccat

SEQ ID NO: 62322 - DNA, 20 bp, Artificial Sequence
  sgRNA
  Tnfrsf23_3
gattgcagaccagaatatgg

SEQ ID NO: 62323 - DNA, 20 bp, Artificial Sequence
  sgRNA
  Tnfrsf23_4
tgttgcaagacctgtccctc

SEQ ID NO: 62324 - DNA, 20 bp, Artificial Sequence
  sgRNA
  Tnfrsf23_5
tactccttcaactgtcccga

SEQ ID NO: 62325 - DNA, 20 bp, Artificial Sequence
  sgRNA
  Tnfrsf23_6
agtgactcagactggagacg

SEQ ID NO: 62326 - DNA, 20 bp, Artificial Sequence
  sgRNA
  Tnfrsf23_7
tgcaacagacatcattagac

SEQ ID NO: 62327 - DNA, 20 bp, Artificial Sequence
  sgRNA
  Tnfrsf23_8
ctactatgacccaaaatttc

SEQ ID NO: 62328 - DNA, 20 bp, Artificial Sequence
  sgRNA
  Tnfrsf23_9
gattcagcagcagcagcaag

SEQ ID NO: 62329 - DNA, 20 bp, Artificial Sequence
  sgRNA
  Tnfrsf23_10
tgtcacccaggaacattcac

SEQ ID NO: 62330 - DNA, 20 bp, Artificial Sequence
  sgRNA
  Tnfrsf23_11
actgttctgccaccagtgac

SEQ ID NO: 62331 - DNA, 20 bp, Artificial Sequence
  sgRNA
  Tnfrsf23_12
gtacatgggcggcatgattc

SEQ ID NO: 62332 - DNA, 20 bp, Artificial Sequence
  sgRNA
  Tnfrsf23_13
gctgctgaatctgttcttgc

SEQ ID NO: 62333 - DNA, 20 bp, Artificial Sequence
  sgRNA
  Tnfrsf23_14
ttagactggtattcaccatc

SEQ ID NO: 62334 - DNA, 20 bp, Artificial Sequence
  sgRNA
  Tnfrsf23_15
cagactggagacgtggctga

SEQ ID NO: 62335 - DNA, 20 bp, Artificial Sequence
  sgRNA
  Tnfrsf23_16
ctttccctgtgaatgttcct

SEQ ID NO: 62336 - DNA, 20 bp, Artificial Sequence
  sgRNA
  Tnfrsf23_17
acattcacagggaaagataa

SEQ ID NO: 62337 - DNA, 20 bp, Artificial Sequence
  sgRNA
  Tnfrsf23_18
gaggaaccagtgactcagac

SEQ ID NO: 62338 - DNA, 20 bp, Artificial Sequence
  sgRNA
  Tnfrsf23_19
gcactcgcatttccggtcac

SEQ ID NO: 62339 - DNA, 20 bp, Artificial Sequence
  sgRNA
  Tnfrsf23_20
cggaaatgcgagtgccaaat

SEQ ID NO: 62340 - DNA, 20 bp, Artificial Sequence
  sgRNA
  Tnfrsf25_1
gcaaagtcggacacccactg

SEQ ID NO: 62341 - DNA, 20 bp, Artificial Sequence
  sgRNA
  Tnfrsf25_2
cctggacttaccagtgacca

SEQ ID NO: 62342 - DNA, 20 bp, Artificial Sequence
  sgRNA
  Tnfrsf25_3
ggctacaacaccagtccatg

SEQ ID NO: 62343 - DNA, 20 bp, Artificial Sequence
  sgRNA
  Tnfrsf25_4
gttgcctaccaactggacag

SEQ ID NO: 62344 - DNA, 20 bp, Artificial Sequence
  sgRNA
  Tnfrsf25_5
atggcagccttgtaaggccg

SEQ ID NO: 62345 - DNA, 20 bp, Artificial Sequence
  sgRNA
  Tnfrsf25_6
tatgcggctctggagcgcat

SEQ ID NO: 62346 - DNA, 20 bp, Artificial Sequence
  sgRNA
  Tnfrsf25_7
tttctcttgtgtcccatgcg

SEQ ID NO: 62347 - DNA, 20 bp, Artificial Sequence
  sgRNA
  Tnfrsf25_8
tgatctgtgcatattgtcga

SEQ ID NO: 62348 - DNA, 20 bp, Artificial Sequence
  sgRNA
  Tnfrsf25_9
gggtctggaaggctgtgccg

SEQ ID NO: 62349 - DNA, 20 bp, Artificial Sequence
  sgRNA
  Tnfrsf25_10
cttcatcacagacttggcag

SEQ ID NO: 62350 - DNA, 20 bp, Artificial Sequence
  sgRNA
  Tnfrsf25_11
agacagcagtgcaagcctta

SEQ ID NO: 62351 - DNA, 20 bp, Artificial Sequence
  sgRNA
  Tnfrsf25_12
aggcaggtggagttgccaca

SEQ ID NO: 62352 - DNA, 20 bp, Artificial Sequence
  sgRNA
  Tnfrsf25_13
catactgctggtctcggaag

SEQ ID NO: 62353 - DNA, 20 bp, Artificial Sequence
  sgRNA
  Tnfrsf25_14
aggagttcgtgcgcacgctg

SEQ ID NO: 62354 - DNA, 20 bp, Artificial Sequence
  sgRNA
  Tnfrsf25_15
ttgccacgtatatagaagcc

SEQ ID NO: 62355 - DNA, 20 bp, Artificial Sequence
  sgRNA
  Tnfrsf25_16
gggcagcccctgcaacaaaa

SEQ ID NO: 62356 - DNA, 20 bp, Artificial Sequence
  sgRNA
  Tnfrsf25_17
gcttgagcatctcatactgc

SEQ ID NO: 62357 - DNA, 20 bp, Artificial Sequence
  sgRNA
  Tnfrsf25_18
tccatcacatcgtagagctg

SEQ ID NO: 62358 - DNA, 20 bp, Artificial Sequence
  sgRNA
  Tnfrsf25_19
agtatgagatgctcaagcgc

SEQ ID NO: 62359 - DNA, 20 bp, Artificial Sequence
  sgRNA
  Tnfrsf25_20
tccagttgttgcctaccaac

SEQ ID NO: 62360 - DNA, 20 bp, Artificial Sequence
  sgRNA
  Tnfrsf26_1
actctgaaaactgtttggag

SEQ ID NO: 62361 - DNA, 20 bp, Artificial Sequence
  sgRNA
  Tnfrsf26_2
gaactcaccaatcttacaca

SEQ ID NO: 62362 - DNA, 20 bp, Artificial Sequence
  sgRNA
  Tnfrsf26_3
agtaggtgccctgcttacac

SEQ ID NO: 62363 - DNA, 20 bp, Artificial Sequence
  sgRNA
  Tnfrsf26_4
tctcctggcatggattccgg

SEQ ID NO: 62364 - DNA, 20 bp, Artificial Sequence
  sgRNA
  Tnfrsf26_5
ggcacacacgatcagctgta

SEQ ID NO: 62365 - DNA, 20 bp, Artificial Sequence
  sgRNA
  Tnfrsf26_6
ttacctccggaatccatgcc

SEQ ID NO: 62366 - DNA, 20 bp, Artificial Sequence
  sgRNA
  Tnfrsf26_7
atgaagtgttcagaatcaca

SEQ ID NO: 62367 - DNA, 20 bp, Artificial Sequence
  sgRNA
  Tnfrsf26_8
atgataaccacaatacccag

SEQ ID NO: 62368 - DNA, 20 bp, Artificial Sequence
  sgRNA
  Tnfrsf26_9
cgtgtgtgccagtgtaagca

SEQ ID NO: 62369 - DNA, 20 bp, Artificial Sequence
  sgRNA
  Tnfrsf26_10
gcacacacgatcagctgtac

SEQ ID NO: 62370 - DNA, 20 bp, Artificial Sequence
  sgRNA
  Tnfrsf26_11
gctgctttcatcatcatcat

SEQ ID NO: 62371 - DNA, 20 bp, Artificial Sequence
  sgRNA
  Tnfrsf26_12
tgaactcaccaatcttacac

SEQ ID NO: 62372 - DNA, 20 bp, Artificial Sequence
  sgRNA
  Tnfrsf26_13
gacaagtttgactcagagcc

SEQ ID NO: 62373 - DNA, 20 bp, Artificial Sequence
  sgRNA
  Tnfrsf26_14
tgcgacttctgctactgctg

SEQ ID NO: 62374 - DNA, 20 bp, Artificial Sequence
  sgRNA
  Tnfrsf26_15
tcgtgtgtgccagtgtaagc

SEQ ID NO: 62375 - DNA, 20 bp, Artificial Sequence
  sgRNA
  Tnfrsf26_16
tcctgacgactctgccgtca

SEQ ID NO: 62376 - DNA, 20 bp, Artificial Sequence
  sgRNA
  Tnfrsf26_17
gccctgacggcagagtcgtc

SEQ ID NO: 62377 - DNA, 20 bp, Artificial Sequence
  sgRNA
  Tnfrsf26_18
caggaaatgcaatgccacaa

SEQ ID NO: 62378 - DNA, 20 bp, Artificial Sequence
  sgRNA
  Tnfrsf26_19
actataaccctgtgtaagat

SEQ ID NO: 62379 - DNA, 20 bp, Artificial Sequence
  sgRNA
  Tnfrsf26_20
ctgtgactctgaaaactgtt

SEQ ID NO: 62380 - DNA, 20 bp, Artificial Sequence
  sgRNA
  Tnfrsf4_1
gagccgctgtgatcatacca

SEQ ID NO: 62381 - DNA, 20 bp, Artificial Sequence
  sgRNA
  Tnfrsf4_2
tcacacttggagttacagca

SEQ ID NO: 62382 - DNA, 20 bp, Artificial Sequence
  sgRNA
  Tnfrsf4_3
ttccagataaggtacaactg

SEQ ID NO: 62383 - DNA, 20 bp, Artificial Sequence
  sgRNA
  Tnfrsf4_4
gtagaccaggcacccaacct

SEQ ID NO: 62384 - DNA, 20 bp, Artificial Sequence
  sgRNA
  Tnfrsf4_5
ttgtagccgctgtcctgccg

SEQ ID NO: 62385 - DNA, 20 bp, Artificial Sequence
  sgRNA
  Tnfrsf4_6
ggttgttgcctggagaaaag

SEQ ID NO: 62386 - DNA, 20 bp, Artificial Sequence
  sgRNA
  Tnfrsf4_7
ggccttgtacctgctccgga

SEQ ID NO: 62387 - DNA, 20 bp, Artificial Sequence
  sgRNA
  Tnfrsf4_8
tgtgagtcccagcagcagaa

SEQ ID NO: 62388 - DNA, 20 bp, Artificial Sequence
  sgRNA
  Tnfrsf4_9
cccaccttggtgactcctga

SEQ ID NO: 62389 - DNA, 20 bp, Artificial Sequence
  sgRNA
  Tnfrsf4_10
taggcaatctccaagccttc

SEQ ID NO: 62390 - DNA, 20 bp, Artificial Sequence
  sgRNA
  Tnfrsf4_11
cttcaggaccccgatccagg

SEQ ID NO: 62391 - DNA, 20 bp, Artificial Sequence
  sgRNA
  Tnfrsf4_12
gcacttgtgaccactggggt

SEQ ID NO: 62392 - DNA, 20 bp, Artificial Sequence
  sgRNA
  Tnfrsf4_13
gttaaacatacctaccccag

SEQ ID NO: 62393 - DNA, 20 bp, Artificial Sequence
  sgRNA
  Tnfrsf4_14
cggatgacatagagtatccc

SEQ ID NO: 62394 - DNA, 20 bp, Artificial Sequence
  sgRNA
  Tnfrsf4_15
cacagcggctcaccatacca

SEQ ID NO: 62395 - DNA, 20 bp, Artificial Sequence
  sgRNA
  Tnfrsf4_16
gactgcgtccaagctgtcac

SEQ ID NO: 62396 - DNA, 20 bp, Artificial Sequence
  sgRNA
  Tnfrsf4_17
ctaggagaacagcaaatgca

SEQ ID NO: 62397 - DNA, 20 bp, Artificial Sequence
  sgRNA
  Tnfrsf4_18
gttgccctctccacccacct

SEQ ID NO: 62398 - DNA, 20 bp, Artificial Sequence
  sgRNA
  Tnfrsf4_19
ttgcctggagaaaagtggcc

SEQ ID NO: 62399 - DNA, 20 bp, Artificial Sequence
  sgRNA
  Tnfrsf4_20
gcgtccaagctgtcactggc

SEQ ID NO: 62400 - DNA, 20 bp, Artificial Sequence
  sgRNA
  Tnfrsf8_1
agacctcagccactacccag

SEQ ID NO: 62401 - DNA, 20 bp, Artificial Sequence
  sgRNA
  Tnfrsf8_2
gcaattgggaccagatcccg

SEQ ID NO: 62402 - DNA, 20 bp, Artificial Sequence
  sgRNA
  Tnfrsf8_3
atctaccacaaggcttaggg

SEQ ID NO: 62403 - DNA, 20 bp, Artificial Sequence
  sgRNA
  Tnfrsf8_4
tacaggccttccagtaacac

SEQ ID NO: 62404 - DNA, 20 bp, Artificial Sequence
  sgRNA
  Tnfrsf8_5
gtaagtgtcttgcggtcacc

SEQ ID NO: 62405 - DNA, 20 bp, Artificial Sequence
  sgRNA
  Tnfrsf8_6
actactacgtcaatgaagac

SEQ ID NO: 62406 - DNA, 20 bp, Artificial Sequence
  sgRNA
  Tnfrsf8_7
gatgcttcaagccttcccaa

SEQ ID NO: 62407 - DNA, 20 bp, Artificial Sequence
  sgRNA
  Tnfrsf8_8
gggctcccttgccttggacg

SEQ ID NO: 62408 - DNA, 20 bp, Artificial Sequence
  sgRNA
  Tnfrsf8_9
gagacctcagccactaccca

SEQ ID NO: 62409 - DNA, 20 bp, Artificial Sequence
  sgRNA
  Tnfrsf8_10
gctgggctgtcatccagcag

SEQ ID NO: 62410 - DNA, 20 bp, Artificial Sequence
  sgRNA
  Tnfrsf8_11
cctgttattggtgtgttccg

SEQ ID NO: 62411 - DNA, 20 bp, Artificial Sequence
  sgRNA
  Tnfrsf8_12
ccttggagcttccatctcca

SEQ ID NO: 62412 - DNA, 20 bp, Artificial Sequence
  sgRNA
  Tnfrsf8_13
acaaggttggtgacacgcat

SEQ ID NO: 62413 - DNA, 20 bp, Artificial Sequence
  sgRNA
  Tnfrsf8_14
ccgacacagccatgcccacg

SEQ ID NO: 62414 - DNA, 20 bp, Artificial Sequence
  sgRNA
  Tnfrsf8_15
aagtctctacagctggagga

SEQ ID NO: 62415 - DNA, 20 bp, Artificial Sequence
  sgRNA
  Tnfrsf8_16
tgttcccgtggacaatggag

SEQ ID NO: 62416 - DNA, 20 bp, Artificial Sequence
  sgRNA
  Tnfrsf8_17
gcccacctctccattgtcca

SEQ ID NO: 62417 - DNA, 20 bp, Artificial Sequence
  sgRNA
  Tnfrsf8_18
gtcaccgacccgcttctctg

SEQ ID NO: 62418 - DNA, 20 bp, Artificial Sequence
  sgRNA
  Tnfrsf8_19
ggctgacactcacagattcg

SEQ ID NO: 62419 - DNA, 20 bp, Artificial Sequence
  sgRNA
  Tnfrsf8_20
gcacaagtctctacagctgg

SEQ ID NO: 62420 - DNA, 20 bp, Artificial Sequence
  sgRNA
  Tnfrsf9_1
gtgcatacgtacttcgtcca

SEQ ID NO: 62421 - DNA, 20 bp, Artificial Sequence
  sgRNA
  Tnfrsf9_2
tgtgcttaagaccgggacca

SEQ ID NO: 62422 - DNA, 20 bp, Artificial Sequence
  sgRNA
  Tnfrsf9_3
ccaagtaccttctccagcat

SEQ ID NO: 62423 - DNA, 20 bp, Artificial Sequence
  sgRNA
  Tnfrsf9_4
accaggctgacagttatcac

SEQ ID NO: 62424 - DNA, 20 bp, Artificial Sequence
  sgRNA
  Tnfrsf9_5
ggccaggagctaacgaagca

SEQ ID NO: 62425 - DNA, 20 bp, Artificial Sequence
  sgRNA
  Tnfrsf9_6
ttgctcctctacccacaacg

SEQ ID NO: 62426 - DNA, 20 bp, Artificial Sequence
  sgRNA
  Tnfrsf9_7
acacaccacgtccttctccg

SEQ ID NO: 62427 - DNA, 20 bp, Artificial Sequence
  sgRNA
  Tnfrsf9_8
ggagagaagctcaccacagg

SEQ ID NO: 62428 - DNA, 20 bp, Artificial Sequence
  sgRNA
  Tnfrsf9_9
gcaaagccgatgtcagcgcc

SEQ ID NO: 62429 - DNA, 20 bp, Artificial Sequence
  sgRNA
  Tnfrsf9_10
gtactggcgtctgtcgaccc

SEQ ID NO: 62430 - DNA, 20 bp, Artificial Sequence
  sgRNA
  Tnfrsf9_11
agtaccttctccagcatagg

SEQ ID NO: 62431 - DNA, 20 bp, Artificial Sequence
  sgRNA
  Tnfrsf9_12
atttctgtgactccagaggg

SEQ ID NO: 62432 - DNA, 20 bp, Artificial Sequence
  sgRNA
  Tnfrsf9_13
actctgcagatgttacagtt

SEQ ID NO: 62433 - DNA, 20 bp, Artificial Sequence
  sgRNA
  Tnfrsf9_14
ggaacatttaatgaccagaa

SEQ ID NO: 62434 - DNA, 20 bp, Artificial Sequence
  sgRNA
  Tnfrsf9_15
gttatcacaggagttctgca

SEQ ID NO: 62435 - DNA, 20 bp, Artificial Sequence
  sgRNA
  Tnfrsf9_16
ttgtagctgccgatgtccac

SEQ ID NO: 62436 - DNA, 20 bp, Artificial Sequence
  sgRNA
  Tnfrsf9_17
ctagtgggctgtgagaaggt

SEQ ID NO: 62437 - DNA, 20 bp, Artificial Sequence
  sgRNA
  Tnfrsf9_18
cttgttcctggcgctgacat

SEQ ID NO: 62438 - DNA, 20 bp, Artificial Sequence
  sgRNA
  Tnfrsf9_19
accatttctgtgactccaga

SEQ ID NO: 62439 - DNA, 20 bp, Artificial Sequence
  sgRNA
  Tnfrsf9_20
tgctggagaaggtacttgga

SEQ ID NO: 62440 - DNA, 20 bp, Artificial Sequence
  sgRNA
  Tnfsf11_1
gcctcgatcgtggtaccaag

SEQ ID NO: 62441 - DNA, 20 bp, Artificial Sequence
  sgRNA
  Tnfsf11_2
gaccctcgtgtgggacgccg

SEQ ID NO: 62442 - DNA, 20 bp, Artificial Sequence
  sgRNA
  Tnfsf11_3
gttaagcaacggaaaactaa

SEQ ID NO: 62443 - DNA, 20 bp, Artificial Sequence
  sgRNA
  Tnfsf11_4
agatttgcaggactcgactc

SEQ ID NO: 62444 - DNA, 20 bp, Artificial Sequence
  sgRNA
  Tnfsf11_5
tctaacatgacgttaagcaa

SEQ ID NO: 62445 - DNA, 20 bp, Artificial Sequence
  sgRNA
  Tnfsf11_6
ggtgcagcggaccctcgtgt

SEQ ID NO: 62446 - DNA, 20 bp, Artificial Sequence
  sgRNA
  Tnfsf11_7
atcttgatccggatccagca

SEQ ID NO: 62447 - DNA, 20 bp, Artificial Sequence
  sgRNA
  Tnfsf11_8
gatgaaacaagcctttcagg

SEQ ID NO: 62448 - DNA, 20 bp, Artificial Sequence
  sgRNA
  Tnfsf11_9
gcaggtacttgccgtagtct

SEQ ID NO: 62449 - DNA, 20 bp, Artificial Sequence
  sgRNA
  Tnfsf11_10
catcttgatccggatccagc

SEQ ID NO: 62450 - DNA, 20 bp, Artificial Sequence
  sgRNA
  Tnfsf11_11
gatccggatccagcagggaa

SEQ ID NO: 62451 - DNA, 20 bp, Artificial Sequence
  sgRNA
  Tnfsf11_12
gtacttgccgtagtctcggc

SEQ ID NO: 62452 - DNA, 20 bp, Artificial Sequence
  sgRNA
  Tnfsf11_13
tcaagatgcgacgtactttg

SEQ ID NO: 62453 - DNA, 20 bp, Artificial Sequence
  sgRNA
  Tnfsf11_14
ggatgaaacaagcctttcag

SEQ ID NO: 62454 - DNA, 20 bp, Artificial Sequence
  sgRNA
  Tnfsf11_15
ctttcggcatcatgaaacat

SEQ ID NO: 62455 - DNA, 20 bp, Artificial Sequence
  sgRNA
  Tnfsf11_16
agggagcacgaaaaactggt

SEQ ID NO: 62456 - DNA, 20 bp, Artificial Sequence
  sgRNA
  Tnfsf11_17
cggcaagtacctgcgcagct

SEQ ID NO: 62457 - DNA, 20 bp, Artificial Sequence
  sgRNA
  Tnfsf11_18
caagtacctgcgcagctcgg

SEQ ID NO: 62458 - DNA, 20 bp, Artificial Sequence
  sgRNA
  Tnfsf11_19
caatgctgccagcatcccat

SEQ ID NO: 62459 - DNA, 20 bp, Artificial Sequence
  sgRNA
  Tnfsf11_20
tctcataacctgatgaaagg

SEQ ID NO: 62460 - DNA, 20 bp, Artificial Sequence
  sgRNA
  Tnfsf13b_1
ggtcaactctggagcacccg

SEQ ID NO: 62461 - DNA, 20 bp, Artificial Sequence
  sgRNA
  Tnfsf13b_2
cggctggtgttgctgaacct

SEQ ID NO: 62462 - DNA, 20 bp, Artificial Sequence
  sgRNA
  Tnfsf13b_3
gcccaacaattcctgctact

SEQ ID NO: 62463 - DNA, 20 bp, Artificial Sequence
  sgRNA
  Tnfsf13b_4
atggagctgcagagctaccg

SEQ ID NO: 62464 - DNA, 20 bp, Artificial Sequence
  sgRNA
  Tnfsf13b_5
ggtgctccagagttgaccgc

SEQ ID NO: 62465 - DNA, 20 bp, Artificial Sequence
  sgRNA
  Tnfsf13b_6
agacctgatgaacctgcgca

SEQ ID NO: 62466 - DNA, 20 bp, Artificial Sequence
  sgRNA
  Tnfsf13b_7
aatgcacagatttcacgcaa

SEQ ID NO: 62467 - DNA, 20 bp, Artificial Sequence
  sgRNA
  Tnfsf13b_8
cgaccccacaactccagccg

SEQ ID NO: 62468 - DNA, 20 bp, Artificial Sequence
  sgRNA
  Tnfsf13b_9
aggaacagacgcgctttcca

SEQ ID NO: 62469 - DNA, 20 bp, Artificial Sequence
  sgRNA
  Tnfsf13b_10
gagcaaaaacagaggcacgg

SEQ ID NO: 62470 - DNA, 20 bp, Artificial Sequence
  sgRNA
  Tnfsf13b_11
ggagaaagagaacaaaatag

SEQ ID NO: 62471 - DNA, 20 bp, Artificial Sequence
  sgRNA
  Tnfsf13b_12
atcactccgcagaaggagga

SEQ ID NO: 62472 - DNA, 20 bp, Artificial Sequence
  sgRNA
  Tnfsf13b_13
cgcgtctgttcctgtggccg

SEQ ID NO: 62473 - DNA, 20 bp, Artificial Sequence
  sgRNA
  Tnfsf13b_14
gaaatctgtgcattctcccg

SEQ ID NO: 62474 - DNA, 20 bp, Artificial Sequence
  sgRNA
  Tnfsf13b_15
ggacaacagggccagcagga

SEQ ID NO: 62475 - DNA, 20 bp, Artificial Sequence
  sgRNA
  Tnfsf13b_16
acatgacccatagcaaagat

SEQ ID NO: 62476 - DNA, 20 bp, Artificial Sequence
  sgRNA
  Tnfsf13b_17
ctatacgaaaaggtaatgac

SEQ ID NO: 62477 - DNA, 20 bp, Artificial Sequence
  sgRNA
  Tnfsf13b_18
gctggctgctaccctcctgc

SEQ ID NO: 62478 - DNA, 20 bp, Artificial Sequence
  sgRNA
  Tnfsf13b_19
tcggagcaaaaacagaggca

SEQ ID NO: 62479 - DNA, 20 bp, Artificial Sequence
  sgRNA
  Tnfsf13b_20
ttcagcaacaccagccgccg

SEQ ID NO: 62480 - DNA, 20 bp, Artificial Sequence
  sgRNA
  Tnfsf15_1
aggctgtagacacaggccag

SEQ ID NO: 62481 - DNA, 20 bp, Artificial Sequence
  sgRNA
  Tnfsf15_2
gaagtacatcaacaaatccc

SEQ ID NO: 62482 - DNA, 20 bp, Artificial Sequence
  sgRNA
  Tnfsf15_3
ggtccctcggaatgtgatct

SEQ ID NO: 62483 - DNA, 20 bp, Artificial Sequence
  sgRNA
  Tnfsf15_4
gaaggatggcagaggagctg

SEQ ID NO: 62484 - DNA, 20 bp, Artificial Sequence
  sgRNA
  Tnfsf15_5
actcccagatcacattccga

SEQ ID NO: 62485 - DNA, 20 bp, Artificial Sequence
  sgRNA
  Tnfsf15_6
tgtgtggtgacatcagtcgg

SEQ ID NO: 62486 - DNA, 20 bp, Artificial Sequence
  sgRNA
  Tnfsf15_7
acttggaccctgttagtagg

SEQ ID NO: 62487 - DNA, 20 bp, Artificial Sequence
  sgRNA
  Tnfsf15_8
aggacttagcaccctcctaa

SEQ ID NO: 62488 - DNA, 20 bp, Artificial Sequence
  sgRNA
  Tnfsf15_9
gtgtgtggtgacatcagtcg

SEQ ID NO: 62489 - DNA, 20 bp, Artificial Sequence
  sgRNA
  Tnfsf15_10
ggatggccttcaccaagaac

SEQ ID NO: 62490 - DNA, 20 bp, Artificial Sequence
  sgRNA
  Tnfsf15_11
gggatggccttcaccaagaa

SEQ ID NO: 62491 - DNA, 20 bp, Artificial Sequence
  sgRNA
  Tnfsf15_12
gctctcggcttgcctctggg

SEQ ID NO: 62492 - DNA, 20 bp, Artificial Sequence
  sgRNA
  Tnfsf15_13
caagccagactccatcacca

SEQ ID NO: 62493 - DNA, 20 bp, Artificial Sequence
  sgRNA
  Tnfsf15_14
ccagtggaagtgctgccgga

SEQ ID NO: 62494 - DNA, 20 bp, Artificial Sequence
  sgRNA
  Tnfsf15_15
tctccaagacagcagaagga

SEQ ID NO: 62495 - DNA, 20 bp, Artificial Sequence
  sgRNA
  Tnfsf15_16
agtcccagtggaagtgctgc

SEQ ID NO: 62496 - DNA, 20 bp, Artificial Sequence
  sgRNA
  Tnfsf15_17
agcctgcccgcctactaaca

SEQ ID NO: 62497 - DNA, 20 bp, Artificial Sequence
  sgRNA
  Tnfsf15_18
cttccggcagcacttccact

SEQ ID NO: 62498 - DNA, 20 bp, Artificial Sequence
  sgRNA
  Tnfsf15_19
cttcggagaaggagtcccag

SEQ ID NO: 62499 - DNA, 20 bp, Artificial Sequence
  sgRNA
  Tnfsf15_20
tcctgactctgggatcacca

SEQ ID NO: 62500 - DNA, 20 bp, Artificial Sequence
  sgRNA
  Tnfsf18_1
gtgtgaatacgacatctgat

SEQ ID NO: 62501 - DNA, 20 bp, Artificial Sequence
  sgRNA
  Tnfsf18_2
atatatctgtactacgaagg

SEQ ID NO: 62502 - DNA, 20 bp, Artificial Sequence
  sgRNA
  Tnfsf18_3
ctacggccaagtgattcctg

SEQ ID NO: 62503 - DNA, 20 bp, Artificial Sequence
  sgRNA
  Tnfsf18_4
ctcaccaaacttaaccatgc

SEQ ID NO: 62504 - DNA, 20 bp, Artificial Sequence
  sgRNA
  Tnfsf18_5
ttatatatctgtactacgaa

SEQ ID NO: 62505 - DNA, 20 bp, Artificial Sequence
  sgRNA
  Tnfsf18_6
agaaaactaacacatactgg

SEQ ID NO: 62506 - DNA, 20 bp, Artificial Sequence
  sgRNA
  Tnfsf18_7
gatgtcgtattcacacagtg

SEQ ID NO: 62507 - DNA, 20 bp, Artificial Sequence
  sgRNA
  Tnfsf18_8
agttcataaacccctcctat

SEQ ID NO: 62508 - DNA, 20 bp, Artificial Sequence
  sgRNA
  Tnfsf18_9
tcttatccacaggaatcact

SEQ ID NO: 62509 - DNA, 20 bp, Artificial Sequence
  sgRNA
  Tnfsf18_10
agtggcacatatttaatcta

SEQ ID NO: 62510 - DNA, 20 bp, Artificial Sequence
  sgRNA
  Tnfsf18_11
tttcaaatcttgcctatagg

SEQ ID NO: 62511 - DNA, 20 bp, Artificial Sequence
  sgRNA
  Tnfsf18_12
gagagaatcaagtcctcaaa

SEQ ID NO: 62512 - DNA, 20 bp, Artificial Sequence
  sgRNA
  Tnfsf18_13
cttaaccatgcaggactcga

SEQ ID NO: 62513 - DNA, 20 bp, Artificial Sequence
  sgRNA
  Tnfsf18_14
ttcaaatcttgcctatagga

SEQ ID NO: 62514 - DNA, 20 bp, Artificial Sequence
  sgRNA
  Tnfsf18_15
tcaaatcttgcctataggag

SEQ ID NO: 62515 - DNA, 20 bp, Artificial Sequence
  sgRNA
  Tnfsf18_16
caagtcctcaaagggcagag

SEQ ID NO: 62516 - DNA, 20 bp, Artificial Sequence
  sgRNA
  Tnfsf18_17
tatatatctgtactacgaag

SEQ ID NO: 62517 - DNA, 20 bp, Artificial Sequence
  sgRNA
  Tnfsf18_18
ggggtttatgaactgcatgc

SEQ ID NO: 62518 - DNA, 20 bp, Artificial Sequence
  sgRNA
  Tnfsf18_19
tgaggacttgattctctcaa

SEQ ID NO: 62519 - DNA, 20 bp, Artificial Sequence
  sgRNA
  Tnfsf18_20
aagctgaagatactgcagag

SEQ ID NO: 62520 - DNA, 20 bp, Artificial Sequence
  sgRNA
  Tnfsf4_1
gaatgagtatcaaactatgg

SEQ ID NO: 62521 - DNA, 20 bp, Artificial Sequence
  sgRNA
  Tnfsf4_2
actggtgcatcttaccggag

SEQ ID NO: 62522 - DNA, 20 bp, Artificial Sequence
  sgRNA
  Tnfsf4_3
agatgggattatgatcctcc

SEQ ID NO: 62523 - DNA, 20 bp, Artificial Sequence
  sgRNA
  Tnfsf4_4
cggttgtcatcaagtgcgat

SEQ ID NO: 62524 - DNA, 20 bp, Artificial Sequence
  sgRNA
  Tnfsf4_5
gattgaccttcatttccggg

SEQ ID NO: 62525 - DNA, 20 bp, Artificial Sequence
  sgRNA
  Tnfsf4_6
tctattccaatgctgaacga

SEQ ID NO: 62526 - DNA, 20 bp, Artificial Sequence
  sgRNA
  Tnfsf4_7
cttcgaccatcgttcagcat

SEQ ID NO: 62527 - DNA, 20 bp, Artificial Sequence
  sgRNA
  Tnfsf4_8
gtacttggttcacagtgctg

SEQ ID NO: 62528 - DNA, 20 bp, Artificial Sequence
  sgRNA
  Tnfsf4_9
tatggaggtgcagaacaatt

SEQ ID NO: 62529 - DNA, 20 bp, Artificial Sequence
  sgRNA
  Tnfsf4_10
ctttatatcatctacctgaa

SEQ ID NO: 62530 - DNA, 20 bp, Artificial Sequence
  sgRNA
  Tnfsf4_11
cctccaatccaaagactcag

SEQ ID NO: 62531 - DNA, 20 bp, Artificial Sequence
  sgRNA
  Tnfsf4_12
attgttgtccagctaacgcc

SEQ ID NO: 62532 - DNA, 20 bp, Artificial Sequence
  sgRNA
  Tnfsf4_13
gatcaaggccaagattcaag

SEQ ID NO: 62533 - DNA, 20 bp, Artificial Sequence
  sgRNA
  Tnfsf4_14
gctcctctgagtctttggat

SEQ ID NO: 62534 - DNA, 20 bp, Artificial Sequence
  sgRNA
  Tnfsf4_15
gctccccatcatttatctgg

SEQ ID NO: 62535 - DNA, 20 bp, Artificial Sequence
  sgRNA
  Tnfsf4_16
tcgaaggattgtcttcactg

SEQ ID NO: 62536 - DNA, 20 bp, Artificial Sequence
  sgRNA
  Tnfsf4_17
acacctccagataaatgatg

SEQ ID NO: 62537 - DNA, 20 bp, Artificial Sequence
  sgRNA
  Tnfsf4_18
tcggttgtcatcaagtgcga

SEQ ID NO: 62538 - DNA, 20 bp, Artificial Sequence
  sgRNA
  Tnfsf4_19
tctctgggatcaagggagca

SEQ ID NO: 62539 - DNA, 20 bp, Artificial Sequence
  sgRNA
  Tnfsf4_20
gtgctgtggtaagatccttc

SEQ ID NO: 62540 - DNA, 20 bp, Artificial Sequence
  sgRNA
  Tnfsf8_1
cacaacaaggcacaccagtg

SEQ ID NO: 62541 - DNA, 20 bp, Artificial Sequence
  sgRNA
  Tnfsf8_2
ctggtatatgagtccgtgga

SEQ ID NO: 62542 - DNA, 20 bp, Artificial Sequence
  sgRNA
  Tnfsf8_3
aatgatttgagcactgcacg

SEQ ID NO: 62543 - DNA, 20 bp, Artificial Sequence
  sgRNA
  Tnfsf8_4
gctcttacctcctttaaggg

SEQ ID NO: 62544 - DNA, 20 bp, Artificial Sequence
  sgRNA
  Tnfsf8_5
gagaaggccccccttaaagg

SEQ ID NO: 62545 - DNA, 20 bp, Artificial Sequence
  sgRNA
  Tnfsf8_6
tgatcgccactgccacaaca

SEQ ID NO: 62546 - DNA, 20 bp, Artificial Sequence
  sgRNA
  Tnfsf8_7
tcaactctaccatatcagtc

SEQ ID NO: 62547 - DNA, 20 bp, Artificial Sequence
  sgRNA
  Tnfsf8_8
cgtcctggtatatgagtccg

SEQ ID NO: 62548 - DNA, 20 bp, Artificial Sequence
  sgRNA
  Tnfsf8_9
agggcctcgtgcttctccag

SEQ ID NO: 62549 - DNA, 20 bp, Artificial Sequence
  sgRNA
  Tnfsf8_10
ctgcgacttgtgcttctcca

SEQ ID NO: 62550 - DNA, 20 bp, Artificial Sequence
  sgRNA
  Tnfsf8_11
gcagtgctcaaatcattctg

SEQ ID NO: 62551 - DNA, 20 bp, Artificial Sequence
  sgRNA
  Tnfsf8_12
gcaacaagcaggcagctgtg

SEQ ID NO: 62552 - DNA, 20 bp, Artificial Sequence
  sgRNA
  Tnfsf8_13
cggatagcacattatcaaga

SEQ ID NO: 62553 - DNA, 20 bp, Artificial Sequence
  sgRNA
  Tnfsf8_14
aacaaggcacaccagtgcgg

SEQ ID NO: 62554 - DNA, 20 bp, Artificial Sequence
  sgRNA
  Tnfsf8_15
ggtactggtagtccagaaaa

SEQ ID NO: 62555 - DNA, 20 bp, Artificial Sequence
  sgRNA
  Tnfsf8_16
cacggactcatataccagga

SEQ ID NO: 62556 - DNA, 20 bp, Artificial Sequence
  sgRNA
  Tnfsf8_17
aacgaagatggcaccatcca

SEQ ID NO: 62557 - DNA, 20 bp, Artificial Sequence
  sgRNA
  Tnfsf8_18
ccagcccctggagaagcacg

SEQ ID NO: 62558 - DNA, 20 bp, Artificial Sequence
  sgRNA
  Tnfsf8_19
aacctgatagtccaattccc

SEQ ID NO: 62559 - DNA, 20 bp, Artificial Sequence
  sgRNA
  Tnfsf8_20
taggcccatgacttcttgga

SEQ ID NO: 62560 - DNA, 20 bp, Artificial Sequence
  sgRNA
  Tpbg_1
gccagccgagagatgccccg

SEQ ID NO: 62561 - DNA, 20 bp, Artificial Sequence
  sgRNA
  Tpbg_2
gaatcacatcgtgccccctg

SEQ ID NO: 62562 - DNA, 20 bp, Artificial Sequence
  sgRNA
  Tpbg_3
aaaaggttgcgcacgtaagg

SEQ ID NO: 62563 - DNA, 20 bp, Artificial Sequence
  sgRNA
  Tpbg_4
gctgggttgggtctccgcgt

SEQ ID NO: 62564 - DNA, 20 bp, Artificial Sequence
  sgRNA
  Tpbg_5
atgtagcagtcgcaaaccca

SEQ ID NO: 62565 - DNA, 20 bp, Artificial Sequence
  sgRNA
  Tpbg_6
gttcctggacaacaatccct

SEQ ID NO: 62566 - DNA, 20 bp, Artificial Sequence
  sgRNA
  Tpbg_7
gaagacataggaagtctgca

SEQ ID NO: 62567 - DNA, 20 bp, Artificial Sequence
  sgRNA
  Tpbg_8
gggcatctctcggctggcgg

SEQ ID NO: 62568 - DNA, 20 bp, Artificial Sequence
  sgRNA
  Tpbg_9
ggacctcaggaacaattccc

SEQ ID NO: 62569 - DNA, 20 bp, Artificial Sequence
  sgRNA
  Tpbg_10
ataacatcagagatgcctgc

SEQ ID NO: 62570 - DNA, 20 bp, Artificial Sequence
  sgRNA
  Tpbg_11
gccggggaggtggaagacga

SEQ ID NO: 62571 - DNA, 20 bp, Artificial Sequence
  sgRNA
  Tpbg_12
gctccaggcgtgtaagacct

SEQ ID NO: 62572 - DNA, 20 bp, Artificial Sequence
  sgRNA
  Tpbg_13
cgctcaggccttgcactccg

SEQ ID NO: 62573 - DNA, 20 bp, Artificial Sequence
  sgRNA
  Tpbg_14
ggtccttcacaactccacct

SEQ ID NO: 62574 - DNA, 20 bp, Artificial Sequence
  sgRNA
  Tpbg_15
acgtaaggcggtagatccgc

SEQ ID NO: 62575 - DNA, 20 bp, Artificial Sequence
  sgRNA
  Tpbg_16
tcaggatcagctcctccagg

SEQ ID NO: 62576 - DNA, 20 bp, Artificial Sequence
  sgRNA
  Tpbg_17
ctgggtttgcgactgctaca

SEQ ID NO: 62577 - DNA, 20 bp, Artificial Sequence
  sgRNA
  Tpbg_18
ggtgccttcgagcatctgcc

SEQ ID NO: 62578 - DNA, 20 bp, Artificial Sequence
  sgRNA
  Tpbg_19
tcagagctaaaacaatacct

SEQ ID NO: 62579 - DNA, 20 bp, Artificial Sequence
  sgRNA
  Tpbg_20
tacggttcaaatacaaaacg

SEQ ID NO: 62580 - DNA, 20 bp, Artificial Sequence
  sgRNA
  Tpbgl_1
cgcagcgcaacattaaccgg

SEQ ID NO: 62581 - DNA, 20 bp, Artificial Sequence
  sgRNA
  Tpbgl_2
cggcgatgcacacgagagcg

SEQ ID NO: 62582 - DNA, 20 bp, Artificial Sequence
  sgRNA
  Tpbgl_3
gttgtgtgtgaggcgcagcg

SEQ ID NO: 62583 - DNA, 20 bp, Artificial Sequence
  sgRNA
  Tpbgl_4
ctggatgcacaatttgcgcg

SEQ ID NO: 62584 - DNA, 20 bp, Artificial Sequence
  sgRNA
  Tpbgl_5
ggccggtccaacagtacgcg

SEQ ID NO: 62585 - DNA, 20 bp, Artificial Sequence
  sgRNA
  Tpbgl_6
gcatccagcgttggatgccg

SEQ ID NO: 62586 - DNA, 20 bp, Artificial Sequence
  sgRNA
  Tpbgl_7
gttaatgttgcgctgcgcgt

SEQ ID NO: 62587 - DNA, 20 bp, Artificial Sequence
  sgRNA
  Tpbgl_8
ctaccactaccgctacgagc

SEQ ID NO: 62588 - DNA, 20 bp, Artificial Sequence
  sgRNA
  Tpbgl_9
gcaaattgtgcatccagcgt

SEQ ID NO: 62589 - DNA, 20 bp, Artificial Sequence
  sgRNA
  Tpbgl_10
gcctcgtccaggtctatcag

SEQ ID NO: 62590 - DNA, 20 bp, Artificial Sequence
  sgRNA
  Tpbgl_11
ggatgcgcgtgtcaacgcgc

SEQ ID NO: 62591 - DNA, 20 bp, Artificial Sequence
  sgRNA
  Tpbgl_12
gcctctgatagacctggacg

SEQ ID NO: 62592 - DNA, 20 bp, Artificial Sequence
  sgRNA
  Tpbgl_13
ggtctgcatcctgctcgtag

SEQ ID NO: 62593 - DNA, 20 bp, Artificial Sequence
  sgRNA
  Tpbgl_14
gcgcagcgcaacattaaccg

SEQ ID NO: 62594 - DNA, 20 bp, Artificial Sequence
  sgRNA
  Tpbgl_15
gctctcgtgtgcatcgccgt

SEQ ID NO: 62595 - DNA, 20 bp, Artificial Sequence
  sgRNA
  Tpbgl_16
ccagtgcatccagcatcccg

SEQ ID NO: 62596 - DNA, 20 bp, Artificial Sequence
  sgRNA
  Tpbgl_17
actacagctcaatcacgcgc

SEQ ID NO: 62597 - DNA, 20 bp, Artificial Sequence
  sgRNA
  Tpbgl_18
cagcccgaagaagacgtaag

SEQ ID NO: 62598 - DNA, 20 bp, Artificial Sequence
  sgRNA
  Tpbgl_19
gtgaggttgcgcgcgtcggg

SEQ ID NO: 62599 - DNA, 20 bp, Artificial Sequence
  sgRNA
  Tpbgl_20
gttactgcttcggcagcccc

SEQ ID NO: 62600 - DNA, 20 bp, Artificial Sequence
  sgRNA
  Tpcn1_1
agaaacacgaggtaactcca

SEQ ID NO: 62601 - DNA, 20 bp, Artificial Sequence
  sgRNA
  Tpcn1_2
cctcgatgaactgcaccacg

SEQ ID NO: 62602 - DNA, 20 bp, Artificial Sequence
  sgRNA
  Tpcn1_3
caagccccggatgagtgcaa

SEQ ID NO: 62603 - DNA, 20 bp, Artificial Sequence
  sgRNA
  Tpcn1_4
ctgggagatgaattatcaag

SEQ ID NO: 62604 - DNA, 20 bp, Artificial Sequence
  sgRNA
  Tpcn1_5
gctccagtgggacgtctgcg

SEQ ID NO: 62605 - DNA, 20 bp, Artificial Sequence
  sgRNA
  Tpcn1_6
gagtctgaagatgtaccagg

SEQ ID NO: 62606 - DNA, 20 bp, Artificial Sequence
  sgRNA
  Tpcn1_7
gttgaaggtgtcgaacacca

SEQ ID NO: 62607 - DNA, 20 bp, Artificial Sequence
  sgRNA
  Tpcn1_8
gctcatcctgaccttggacg

SEQ ID NO: 62608 - DNA, 20 bp, Artificial Sequence
  sgRNA
  Tpcn1_9
gggcaataagaccaaggtag

SEQ ID NO: 62609 - DNA, 20 bp, Artificial Sequence
  sgRNA
  Tpcn1_10
agtgtggttgatgaaccggt

SEQ ID NO: 62610 - DNA, 20 bp, Artificial Sequence
  sgRNA
  Tpcn1_11
gcatggagttcttcaacggg

SEQ ID NO: 62611 - DNA, 20 bp, Artificial Sequence
  sgRNA
  Tpcn1_12
gatgaactgcaccacgagga

SEQ ID NO: 62612 - DNA, 20 bp, Artificial Sequence
  sgRNA
  Tpcn1_13
ctcacgataaagctccagga

SEQ ID NO: 62613 - DNA, 20 bp, Artificial Sequence
  sgRNA
  Tpcn1_14
tcgccgtcccagaaacacca

SEQ ID NO: 62614 - DNA, 20 bp, Artificial Sequence
  sgRNA
  Tpcn1_15
gttcaaataccaccaccatg

SEQ ID NO: 62615 - DNA, 20 bp, Artificial Sequence
  sgRNA
  Tpcn1_16
ggtggtgatgaccattatcg

SEQ ID NO: 62616 - DNA, 20 bp, Artificial Sequence
  sgRNA
  Tpcn1_17
gtttgtgccggacgaacgtg

SEQ ID NO: 62617 - DNA, 20 bp, Artificial Sequence
  sgRNA
  Tpcn1_18
taagccttcgaactgcctgt

SEQ ID NO: 62618 - DNA, 20 bp, Artificial Sequence
  sgRNA
  Tpcn1_19
tcacctcgcagacgtcccac

SEQ ID NO: 62619 - DNA, 20 bp, Artificial Sequence
  sgRNA
  Tpcn1_20
cgtccggcacaaacgtacca

SEQ ID NO: 62620 - DNA, 20 bp, Artificial Sequence
  sgRNA
  Tpo_1
ggtttggatccgatagtgag

SEQ ID NO: 62621 - DNA, 20 bp, Artificial Sequence
  sgRNA
  Tpo_2
tctaaatgagtaccaaccgg

SEQ ID NO: 62622 - DNA, 20 bp, Artificial Sequence
  sgRNA
  Tpo_3
tggcagcggtacacaccttg

SEQ ID NO: 62623 - DNA, 20 bp, Artificial Sequence
  sgRNA
  Tpo_4
tgagggaaattacctgtatg

SEQ ID NO: 62624 - DNA, 20 bp, Artificial Sequence
  sgRNA
  Tpo_5
ataagtaccggcccatcaca

SEQ ID NO: 62625 - DNA, 20 bp, Artificial Sequence
  sgRNA
  Tpo_6
acctgtctgcagccaatccg

SEQ ID NO: 62626 - DNA, 20 bp, Artificial Sequence
  sgRNA
  Tpo_7
gcatcactgaacttgcagag

SEQ ID NO: 62627 - DNA, 20 bp, Artificial Sequence
  sgRNA
  Tpo_8
gtgttgtcacagatgacccg

SEQ ID NO: 62628 - DNA, 20 bp, Artificial Sequence
  sgRNA
  Tpo_9
ggcatcactgaacttgcaga

SEQ ID NO: 62629 - DNA, 20 bp, Artificial Sequence
  sgRNA
  Tpo_10
ggaacctgcaagtggatcca

SEQ ID NO: 62630 - DNA, 20 bp, Artificial Sequence
  sgRNA
  Tpo_11
ttagccgtctcaccagtgga

SEQ ID NO: 62631 - DNA, 20 bp, Artificial Sequence
  sgRNA
  Tpo_12
aagccatcttcatagacagg

SEQ ID NO: 62632 - DNA, 20 bp, Artificial Sequence
  sgRNA
  Tpo_13
gcgcaggcggctgttgcgaa

SEQ ID NO: 62633 - DNA, 20 bp, Artificial Sequence
  sgRNA
  Tpo_14
gattatatccccaaaatcct

SEQ ID NO: 62634 - DNA, 20 bp, Artificial Sequence
  sgRNA
  Tpo_15
gtccccagtgccacaagcgg

SEQ ID NO: 62635 - DNA, 20 bp, Artificial Sequence
  sgRNA
  Tpo_16
cctggatagtaatttgcagg

SEQ ID NO: 62636 - DNA, 20 bp, Artificial Sequence
  sgRNA
  Tpo_17
gcacagtgcaagaacaccaa

SEQ ID NO: 62637 - DNA, 20 bp, Artificial Sequence
  sgRNA
  Tpo_18
taagtaccggcccatcacag

SEQ ID NO: 62638 - DNA, 20 bp, Artificial Sequence
  sgRNA
  Tpo_19
gcttcagtcagcccaaaggc

SEQ ID NO: 62639 - DNA, 20 bp, Artificial Sequence
  sgRNA
  Tpo_20
gttcagtgatgccagatcca

SEQ ID NO: 62640 - DNA, 20 bp, Artificial Sequence
  sgRNA
  Tpra1_1
gtaggccagagacaatactg

SEQ ID NO: 62641 - DNA, 20 bp, Artificial Sequence
  sgRNA
  Tpra1_2
agaagcgggtgatttcccac

SEQ ID NO: 62642 - DNA, 20 bp, Artificial Sequence
  sgRNA
  Tpra1_3
ggatacacgctccttcagtg

SEQ ID NO: 62643 - DNA, 20 bp, Artificial Sequence
  sgRNA
  Tpra1_4
agccctggcaatgcctacca

SEQ ID NO: 62644 - DNA, 20 bp, Artificial Sequence
  sgRNA
  Tpra1_5
gccacactcaacctgctgca

SEQ ID NO: 62645 - DNA, 20 bp, Artificial Sequence
  sgRNA
  Tpra1_6
aggccaatggaagcacagcg

SEQ ID NO: 62646 - DNA, 20 bp, Artificial Sequence
  sgRNA
  Tpra1_7
tctgcgctaacatcattgtg

SEQ ID NO: 62647 - DNA, 20 bp, Artificial Sequence
  sgRNA
  Tpra1_8
gctctgcgctaacatcattg

SEQ ID NO: 62648 - DNA, 20 bp, Artificial Sequence
  sgRNA
  Tpra1_9
gcacacagtttgactctgct

SEQ ID NO: 62649 - DNA, 20 bp, Artificial Sequence
  sgRNA
  Tpra1_10
cagactctatgccctcgcgc

SEQ ID NO: 62650 - DNA, 20 bp, Artificial Sequence
  sgRNA
  Tpra1_11
gagcaagtccagcatcaagc

SEQ ID NO: 62651 - DNA, 20 bp, Artificial Sequence
  sgRNA
  Tpra1_12
gctggagtagttggcggcag

SEQ ID NO: 62652 - DNA, 20 bp, Artificial Sequence
  sgRNA
  Tpra1_13
gagctgagtgtgatcatcct

SEQ ID NO: 62653 - DNA, 20 bp, Artificial Sequence
  sgRNA
  Tpra1_14
gctcttcagcctcgtccact

SEQ ID NO: 62654 - DNA, 20 bp, Artificial Sequence
  sgRNA
  Tpra1_15
gcagcaggaggtcccagtac

SEQ ID NO: 62655 - DNA, 20 bp, Artificial Sequence
  sgRNA
  Tpra1_16
ttgatgctgcccgtgtggca

SEQ ID NO: 62656 - DNA, 20 bp, Artificial Sequence
  sgRNA
  Tpra1_17
agagcaagtccagcatcaag

SEQ ID NO: 62657 - DNA, 20 bp, Artificial Sequence
  sgRNA
  Tpra1_18
aggagtttctacgtgtatgc

SEQ ID NO: 62658 - DNA, 20 bp, Artificial Sequence
  sgRNA
  Tpra1_19
ctgtgtgctggagtagttgg

SEQ ID NO: 62659 - DNA, 20 bp, Artificial Sequence
  sgRNA
  Tpra1_20
ctgatattggatgctgtggg

SEQ ID NO: 62660 - DNA, 20 bp, Artificial Sequence
  sgRNA
  Tpsg1_1
cgggaagtcgaatcgtggga

SEQ ID NO: 62661 - DNA, 20 bp, Artificial Sequence
  sgRNA
  Tpsg1_2
gcccccatacaaccttcagg

SEQ ID NO: 62662 - DNA, 20 bp, Artificial Sequence
  sgRNA
  Tpsg1_3
caggcttacaatagtcccaa

SEQ ID NO: 62663 - DNA, 20 bp, Artificial Sequence
  sgRNA
  Tpsg1_4
tcacccagcactgcatccca

SEQ ID NO: 62664 - DNA, 20 bp, Artificial Sequence
  sgRNA
  Tpsg1_5
gctgagctctccctcccacg

SEQ ID NO: 62665 - DNA, 20 bp, Artificial Sequence
  sgRNA
  Tpsg1_6
gtttacataggcagtaaccc

SEQ ID NO: 62666 - DNA, 20 bp, Artificial Sequence
  sgRNA
  Tpsg1_7
ctggctctccaggaccaccg

SEQ ID NO: 62667 - DNA, 20 bp, Artificial Sequence
  sgRNA
  Tpsg1_8
cgtgcaccttgtgcagacgg

SEQ ID NO: 62668 - DNA, 20 bp, Artificial Sequence
  sgRNA
  Tpsg1_9
accaccacatcccagaagca

SEQ ID NO: 62669 - DNA, 20 bp, Artificial Sequence
  sgRNA
  Tpsg1_10
cagaaacagccagaaacagt

SEQ ID NO: 62670 - DNA, 20 bp, Artificial Sequence
  sgRNA
  Tpsg1_11
gactggctggggctatacag

SEQ ID NO: 62671 - DNA, 20 bp, Artificial Sequence
  sgRNA
  Tpsg1_12
cggggaggacagctgcacca

SEQ ID NO: 62672 - DNA, 20 bp, Artificial Sequence
  sgRNA
  Tpsg1_13
ggtgcagctgtcctccccgg

SEQ ID NO: 62673 - DNA, 20 bp, Artificial Sequence
  sgRNA
  Tpsg1_14
ggatgtaaagacctgcagcc

SEQ ID NO: 62674 - DNA, 20 bp, Artificial Sequence
  sgRNA
  Tpsg1_15
atgtccccactggaccccgg

SEQ ID NO: 62675 - DNA, 20 bp, Artificial Sequence
  sgRNA
  Tpsg1_16
gagtcctgatggccaagtac

SEQ ID NO: 62676 - DNA, 20 bp, Artificial Sequence
  sgRNA
  Tpsg1_17
cctcagctgacttctaccct

SEQ ID NO: 62677 - DNA, 20 bp, Artificial Sequence
  sgRNA
  Tpsg1_18
gggttactgcctatgtaaac

SEQ ID NO: 62678 - DNA, 20 bp, Artificial Sequence
  sgRNA
  Tpsg1_19
aactcgggaagtcgaatcgt

SEQ ID NO: 62679 - DNA, 20 bp, Artificial Sequence
  sgRNA
  Tpsg1_20
ccagacatgctatgcgcccg

SEQ ID NO: 62680 - DNA, 20 bp, Artificial Sequence
  sgRNA
  Trabd2b_1
agactcgggtatagggaacg

SEQ ID NO: 62681 - DNA, 20 bp, Artificial Sequence
  sgRNA
  Trabd2b_2
tgctcgctcaccgatccagg

SEQ ID NO: 62682 - DNA, 20 bp, Artificial Sequence
  sgRNA
  Trabd2b_3
gctcatggtgaactccctca

SEQ ID NO: 62683 - DNA, 20 bp, Artificial Sequence
  sgRNA
  Trabd2b_4
gagaagttgagcccattgag

SEQ ID NO: 62684 - DNA, 20 bp, Artificial Sequence
  sgRNA
  Trabd2b_5
catcaaacactacaactgcg

SEQ ID NO: 62685 - DNA, 20 bp, Artificial Sequence
  sgRNA
  Trabd2b_6
tggtgtgaggacttgacaaa

SEQ ID NO: 62686 - DNA, 20 bp, Artificial Sequence
  sgRNA
  Trabd2b_7
aatcgacagctacttccggc

SEQ ID NO: 62687 - DNA, 20 bp, Artificial Sequence
  sgRNA
  Trabd2b_8
gagacagatgtgcgctcccg

SEQ ID NO: 62688 - DNA, 20 bp, Artificial Sequence
  sgRNA
  Trabd2b_9
gatggcgccgaatagtccac

SEQ ID NO: 62689 - DNA, 20 bp, Artificial Sequence
  sgRNA
  Trabd2b_10
tcttgtagatgagctcctgc

SEQ ID NO: 62690 - DNA, 20 bp, Artificial Sequence
  sgRNA
  Trabd2b_11
gcaggcaccctacaccacag

SEQ ID NO: 62691 - DNA, 20 bp, Artificial Sequence
  sgRNA
  Trabd2b_12
tgtcctcgattcggacccag

SEQ ID NO: 62692 - DNA, 20 bp, Artificial Sequence
  sgRNA
  Trabd2b_13
gccagggctgagatggtata

SEQ ID NO: 62693 - DNA, 20 bp, Artificial Sequence
  sgRNA
  Trabd2b_14
tggatgacgccagcacagcg

SEQ ID NO: 62694 - DNA, 20 bp, Artificial Sequence
  sgRNA
  Trabd2b_15
caatgggctcaacttctccc

SEQ ID NO: 62695 - DNA, 20 bp, Artificial Sequence
  sgRNA
  Trabd2b_16
tgtgctggcgtcatccagga

SEQ ID NO: 62696 - DNA, 20 bp, Artificial Sequence
  sgRNA
  Trabd2b_17
ggttgcttctgggactgcag

SEQ ID NO: 62697 - DNA, 20 bp, Artificial Sequence
  sgRNA
  Trabd2b_18
tcgatgtcctaagacaggca

SEQ ID NO: 62698 - DNA, 20 bp, Artificial Sequence
  sgRNA
  Trabd2b_19
cagcagctggcaactggcca

SEQ ID NO: 62699 - DNA, 20 bp, Artificial Sequence
  sgRNA
  Trabd2b_20
ttaggctgtcggggagcaag

SEQ ID NO: 62700 - DNA, 20 bp, Artificial Sequence
  sgRNA
  Trat1_1
tctctgcttctctacatagt

SEQ ID NO: 62701 - DNA, 20 bp, Artificial Sequence
  sgRNA
  Trat1_2
cttcacgctgtgatccagtg

SEQ ID NO: 62702 - DNA, 20 bp, Artificial Sequence
  sgRNA
  Trat1_3
aatttagaaaatataatccc

SEQ ID NO: 62703 - DNA, 20 bp, Artificial Sequence
  sgRNA
  Trat1_4
actctgatgactacattcca

SEQ ID NO: 62704 - DNA, 20 bp, Artificial Sequence
  sgRNA
  Trat1_5
gatcaacccaaacagtctag

SEQ ID NO: 62705 - DNA, 20 bp, Artificial Sequence
  sgRNA
  Trat1_6
ctactacctggttatctggt

SEQ ID NO: 62706 - DNA, 20 bp, Artificial Sequence
  sgRNA
  Trat1_7
tctactacctggttatctgg

SEQ ID NO: 62707 - DNA, 20 bp, Artificial Sequence
  sgRNA
  Trat1_8
ggatacacaagtctatacaa

SEQ ID NO: 62708 - DNA, 20 bp, Artificial Sequence
  sgRNA
  Trat1_9
gagatctgcaagcgatccgc

SEQ ID NO: 62709 - DNA, 20 bp, Artificial Sequence
  sgRNA
  Trat1_10
ggatcgcttgcagatctctg

SEQ ID NO: 62710 - DNA, 20 bp, Artificial Sequence
  sgRNA
  Trat1_11
tgacatgctagccctttcag

SEQ ID NO: 62711 - DNA, 20 bp, Artificial Sequence
  sgRNA
  Trat1_12
tcatagcagttctcatccag

SEQ ID NO: 62712 - DNA, 20 bp, Artificial Sequence
  sgRNA
  Trat1_13
gcaggtgcagccacttcctg

SEQ ID NO: 62713 - DNA, 20 bp, Artificial Sequence
  sgRNA
  Trat1_14
caacgtttctcagatcaata

SEQ ID NO: 62714 - DNA, 20 bp, Artificial Sequence
  sgRNA
  Trat1_15
tagcacatctgagcttcagc

SEQ ID NO: 62715 - DNA, 20 bp, Artificial Sequence
  sgRNA
  Trat1_16
aagtttcccaccagataacc

SEQ ID NO: 62716 - DNA, 20 bp, Artificial Sequence
  sgRNA
  Trat1_17
agaaggctagaagtccccag

SEQ ID NO: 62717 - DNA, 20 bp, Artificial Sequence
  sgRNA
  Trat1_18
ggatgccccttcttcctctg

SEQ ID NO: 62718 - DNA, 20 bp, Artificial Sequence
  sgRNA
  Trat1_19
accagataaccaggtagtag

SEQ ID NO: 62719 - DNA, 20 bp, Artificial Sequence
  sgRNA
  Trat1_20
aatactaatgtgtcagacag

SEQ ID NO: 62720 - DNA, 20 bp, Artificial Sequence
  sgRNA
  Treh_1
agattagggaggacctctcg

SEQ ID NO: 62721 - DNA, 20 bp, Artificial Sequence
  sgRNA
  Treh_2
agctacggacatatccccaa

SEQ ID NO: 62722 - DNA, 20 bp, Artificial Sequence
  sgRNA
  Treh_3
aggggaccgagagactctgt

SEQ ID NO: 62723 - DNA, 20 bp, Artificial Sequence
  sgRNA
  Treh_4
aggaacgcgttcagatcagc

SEQ ID NO: 62724 - DNA, 20 bp, Artificial Sequence
  sgRNA
  Treh_5
ccacaaccacagcatcccca

SEQ ID NO: 62725 - DNA, 20 bp, Artificial Sequence
  sgRNA
  Treh_6
gagatggcctcaacagtgaa

SEQ ID NO: 62726 - DNA, 20 bp, Artificial Sequence
  sgRNA
  Treh_7
gctcctgcaccaagttcaga

SEQ ID NO: 62727 - DNA, 20 bp, Artificial Sequence
  sgRNA
  Treh_8
atagcgatccagaagcatca

SEQ ID NO: 62728 - DNA, 20 bp, Artificial Sequence
  sgRNA
  Treh_9
gctgggacttctcttcacgc

SEQ ID NO: 62729 - DNA, 20 bp, Artificial Sequence
  sgRNA
  Treh_10
agagtcacttccagcccgtg

SEQ ID NO: 62730 - DNA, 20 bp, Artificial Sequence
  sgRNA
  Treh_11
tggccaagtcagcttccccc

SEQ ID NO: 62731 - DNA, 20 bp, Artificial Sequence
  sgRNA
  Treh_12
atttggctggacaaacggat

SEQ ID NO: 62732 - DNA, 20 bp, Artificial Sequence
  sgRNA
  Treh_13
caccccttcattgtgcccgg

SEQ ID NO: 62733 - DNA, 20 bp, Artificial Sequence
  sgRNA
  Treh_14
gggccatctgaacttggtgc

SEQ ID NO: 62734 - DNA, 20 bp, Artificial Sequence
  sgRNA
  Treh_15
agccacctcctgagtccggg

SEQ ID NO: 62735 - DNA, 20 bp, Artificial Sequence
  sgRNA
  Treh_16
cctgggaccccactgcctag

SEQ ID NO: 62736 - DNA, 20 bp, Artificial Sequence
  sgRNA
  Treh_17
gtgctttgagtagattaggg

SEQ ID NO: 62737 - DNA, 20 bp, Artificial Sequence
  sgRNA
  Treh_18
cgcgttcctgtgccaagcag

SEQ ID NO: 62738 - DNA, 20 bp, Artificial Sequence
  sgRNA
  Treh_19
ccagagtcacttccagcccg

SEQ ID NO: 62739 - DNA, 20 bp, Artificial Sequence
  sgRNA
  Treh_20
aattcaacaaagcgcccccc

SEQ ID NO: 62740 - DNA, 20 bp, Artificial Sequence
  sgRNA
  Trem1_1
cctgaaacatgaccctagtg

SEQ ID NO: 62741 - DNA, 20 bp, Artificial Sequence
  sgRNA
  Trem1_2
agaaaggtatgacctagtgg

SEQ ID NO: 62742 - DNA, 20 bp, Artificial Sequence
  sgRNA
  Trem1_3
caggatggaagagcacaaca

SEQ ID NO: 62743 - DNA, 20 bp, Artificial Sequence
  sgRNA
  Trem1_4
cgggaaggaacccttgaccc

SEQ ID NO: 62744 - DNA, 20 bp, Artificial Sequence
  sgRNA
  Trem1_5
agacccagtgaagtccacat

SEQ ID NO: 62745 - DNA, 20 bp, Artificial Sequence
  sgRNA
  Trem1_6
cttgtagcatggcctcacta

SEQ ID NO: 62746 - DNA, 20 bp, Artificial Sequence
  sgRNA
  Trem1_7
gtccgcctggtggtgaccaa

SEQ ID NO: 62747 - DNA, 20 bp, Artificial Sequence
  sgRNA
  Trem1_8
tcaaagtctggccctccact

SEQ ID NO: 62748 - DNA, 20 bp, Artificial Sequence
  sgRNA
  Trem1_9
atccctacccaagcccactg

SEQ ID NO: 62749 - DNA, 20 bp, Artificial Sequence
  sgRNA
  Trem1_10
agcacaacagggtcattcgg

SEQ ID NO: 62750 - DNA, 20 bp, Artificial Sequence
  sgRNA
  Trem1_11
gcttggcagagactaccaga

SEQ ID NO: 62751 - DNA, 20 bp, Artificial Sequence
  sgRNA
  Trem1_12
acttcactgggtcttgtaaa

SEQ ID NO: 62752 - DNA, 20 bp, Artificial Sequence
  sgRNA
  Trem1_13
gaaaggtatgacctagtgga

SEQ ID NO: 62753 - DNA, 20 bp, Artificial Sequence
  sgRNA
  Trem1_14
tcttattcattgtcacaaag

SEQ ID NO: 62754 - DNA, 20 bp, Artificial Sequence
  sgRNA
  Trem1_15
gaagtatgccaacagccaga

SEQ ID NO: 62755 - DNA, 20 bp, Artificial Sequence
  sgRNA
  Trem1_16
tgaccctggtggtcacacag

SEQ ID NO: 62756 - DNA, 20 bp, Artificial Sequence
  sgRNA
  Trem1_17
gatgactgaaatagtaacac

SEQ ID NO: 62757 - DNA, 20 bp, Artificial Sequence
  sgRNA
  Trem1_18
gctcttccatcctgtccgcc

SEQ ID NO: 62758 - DNA, 20 bp, Artificial Sequence
  sgRNA
  Trem1_19
gcatacttcatgatgttgaa

SEQ ID NO: 62759 - DNA, 20 bp, Artificial Sequence
  sgRNA
  Trem1_20
gggcctctgtgtgaccacca

SEQ ID NO: 62760 - DNA, 20 bp, Artificial Sequence
  sgRNA
  Trem2_1
tatgacgccttgaagcactg

SEQ ID NO: 62761 - DNA, 20 bp, Artificial Sequence
  sgRNA
  Trem2_2
cgaaactcgatgactcctcg

SEQ ID NO: 62762 - DNA, 20 bp, Artificial Sequence
  sgRNA
  Trem2_3
taccagtgtcagagtctccg

SEQ ID NO: 62763 - DNA, 20 bp, Artificial Sequence
  sgRNA
  Trem2_4
actctgaagaacctccaagc

SEQ ID NO: 62764 - DNA, 20 bp, Artificial Sequence
  sgRNA
  Trem2_5
gaggagtcatcgagtttcga

SEQ ID NO: 62765 - DNA, 20 bp, Artificial Sequence
  sgRNA
  Trem2_6
ggtcctgcagaaagtactgg

SEQ ID NO: 62766 - DNA, 20 bp, Artificial Sequence
  sgRNA
  Trem2_7
cgaggagtcatcgagtttcg

SEQ ID NO: 62767 - DNA, 20 bp, Artificial Sequence
  sgRNA
  Trem2_8
tcagagtctccgaggccgag

SEQ ID NO: 62768 - DNA, 20 bp, Artificial Sequence
  sgRNA
  Trem2_9
ctcaacaccacggtgctgca

SEQ ID NO: 62769 - DNA, 20 bp, Artificial Sequence
  sgRNA
  Trem2_10
tggagatctctgggtccccg

SEQ ID NO: 62770 - DNA, 20 bp, Artificial Sequence
  sgRNA
  Trem2_11
ggaggtgctgtgttccactt

SEQ ID NO: 62771 - DNA, 20 bp, Artificial Sequence
  sgRNA
  Trem2_12
ggccatgccctgcagcaccg

SEQ ID NO: 62772 - DNA, 20 bp, Artificial Sequence
  sgRNA
  Trem2_13
gtcccaagccctcaacacca

SEQ ID NO: 62773 - DNA, 20 bp, Artificial Sequence
  sgRNA
  Trem2_14
ggagactctgacactggtag

SEQ ID NO: 62774 - DNA, 20 bp, Artificial Sequence
  sgRNA
  Trem2_15
gatggtgacggttccagcaa

SEQ ID NO: 62775 - DNA, 20 bp, Artificial Sequence
  sgRNA
  Trem2_16
ggagacgcaaggcctggtgt

SEQ ID NO: 62776 - DNA, 20 bp, Artificial Sequence
  sgRNA
  Trem2_17
ggagggcccatgccagcgtg

SEQ ID NO: 62777 - DNA, 20 bp, Artificial Sequence
  sgRNA
  Trem2_18
ccagcatcttggtcatctag

SEQ ID NO: 62778 - DNA, 20 bp, Artificial Sequence
  sgRNA
  Trem2_19
atgacgccttgaagcactgg

SEQ ID NO: 62779 - DNA, 20 bp, Artificial Sequence
  sgRNA
  Trem2_20
ggtgttgagggcttgggaca

SEQ ID NO: 62780 - DNA, 20 bp, Artificial Sequence
  sgRNA
  Treml2_1
gaaccgccggaacttagttg

SEQ ID NO: 62781 - DNA, 20 bp, Artificial Sequence
  sgRNA
  Treml2_2
caaggtagtccgtatcacca

SEQ ID NO: 62782 - DNA, 20 bp, Artificial Sequence
  sgRNA
  Treml2_3
cgtgacaaatccatccatgg

SEQ ID NO: 62783 - DNA, 20 bp, Artificial Sequence
  sgRNA
  Treml2_4
tacagtttcatcgataccag

SEQ ID NO: 62784 - DNA, 20 bp, Artificial Sequence
  sgRNA
  Treml2_5
tcaacaccaccaccatcgca

SEQ ID NO: 62785 - DNA, 20 bp, Artificial Sequence
  sgRNA
  Treml2_6
tggcctcaactaagttccgg

SEQ ID NO: 62786 - DNA, 20 bp, Artificial Sequence
  sgRNA
  Treml2_7
agtgctcctacaagaaccgc

SEQ ID NO: 62787 - DNA, 20 bp, Artificial Sequence
  sgRNA
  Treml2_8
gccacccgttaactcccaac

SEQ ID NO: 62788 - DNA, 20 bp, Artificial Sequence
  sgRNA
  Treml2_9
ccagttggaaacccaccaaa

SEQ ID NO: 62789 - DNA, 20 bp, Artificial Sequence
  sgRNA
  Treml2_10
gtagcagcttgtccaccacg

SEQ ID NO: 62790 - DNA, 20 bp, Artificial Sequence
  sgRNA
  Treml2_11
gtgtctctggtccttcagga

SEQ ID NO: 62791 - DNA, 20 bp, Artificial Sequence
  sgRNA
  Treml2_12
gcagcaactatgctaaaccc

SEQ ID NO: 62792 - DNA, 20 bp, Artificial Sequence
  sgRNA
  Treml2_13
agtgcgaccacaacttcacc

SEQ ID NO: 62793 - DNA, 20 bp, Artificial Sequence
  sgRNA
  Treml2_14
tgaaactgtagcctgtcaca

SEQ ID NO: 62794 - DNA, 20 bp, Artificial Sequence
  sgRNA
  Treml2_15
gaaactgtagcctgtcacag

SEQ ID NO: 62795 - DNA, 20 bp, Artificial Sequence
  sgRNA
  Treml2_16
ggaaacttacatccctgcga

SEQ ID NO: 62796 - DNA, 20 bp, Artificial Sequence
  sgRNA
  Treml2_17
gggcatttctaccctttggt

SEQ ID NO: 62797 - DNA, 20 bp, Artificial Sequence
  sgRNA
  Treml2_18
ttacatccctgcgatggtgg

SEQ ID NO: 62798 - DNA, 20 bp, Artificial Sequence
  sgRNA
  Treml2_19
tcgtgacaaatccatccatg

SEQ ID NO: 62799 - DNA, 20 bp, Artificial Sequence
  sgRNA
  Treml2_20
atagtcacgtcagatgtgaa

SEQ ID NO: 62800 - DNA, 20 bp, Artificial Sequence
  sgRNA
  Trhde_1
agcttgcgattcgacgagtg

SEQ ID NO: 62801 - DNA, 20 bp, Artificial Sequence
  sgRNA
  Trhde_2
gtgaaaactgagtaacacca

SEQ ID NO: 62802 - DNA, 20 bp, Artificial Sequence
  sgRNA
  Trhde_3
gcagattccattaaccattg

SEQ ID NO: 62803 - DNA, 20 bp, Artificial Sequence
  sgRNA
  Trhde_4
aggcgtgcagtaccacgtag

SEQ ID NO: 62804 - DNA, 20 bp, Artificial Sequence
  sgRNA
  Trhde_5
catcatcgatcaaagccgcg

SEQ ID NO: 62805 - DNA, 20 bp, Artificial Sequence
  sgRNA
  Trhde_6
gtaatgcctctgcgcgtcca

SEQ ID NO: 62806 - DNA, 20 bp, Artificial Sequence
  sgRNA
  Trhde_7
cgtcgggtctcgcatataat

SEQ ID NO: 62807 - DNA, 20 bp, Artificial Sequence
  sgRNA
  Trhde_8
actttctgtcagtaaccgcg

SEQ ID NO: 62808 - DNA, 20 bp, Artificial Sequence
  sgRNA
  Trhde_9
agaatagcgtacttagacag

SEQ ID NO: 62809 - DNA, 20 bp, Artificial Sequence
  sgRNA
  Trhde_10
ggtactgcacgcctcccgag

SEQ ID NO: 62810 - DNA, 20 bp, Artificial Sequence
  sgRNA
  Trhde_11
gagaggattccccacccgcg

SEQ ID NO: 62811 - DNA, 20 bp, Artificial Sequence
  sgRNA
  Trhde_12
ggtatctgatgatctctagg

SEQ ID NO: 62812 - DNA, 20 bp, Artificial Sequence
  sgRNA
  Trhde_13
ggataaattactggaccgca

SEQ ID NO: 62813 - DNA, 20 bp, Artificial Sequence
  sgRNA
  Trhde_14
agctcgtgagaaagaagcag

SEQ ID NO: 62814 - DNA, 20 bp, Artificial Sequence
  sgRNA
  Trhde_15
gcagctttccaggttctgcc

SEQ ID NO: 62815 - DNA, 20 bp, Artificial Sequence
  sgRNA
  Trhde_16
tcccgctcttcctccgacgg

SEQ ID NO: 62816 - DNA, 20 bp, Artificial Sequence
  sgRNA
  Trhde_17
tctctggaatacattatcag

SEQ ID NO: 62817 - DNA, 20 bp, Artificial Sequence
  sgRNA
  Trhde_18
aatgtggagagcatagtccc

SEQ ID NO: 62818 - DNA, 20 bp, Artificial Sequence
  sgRNA
  Trhde_19
cactatcctgggaaacacga

SEQ ID NO: 62819 - DNA, 20 bp, Artificial Sequence
  sgRNA
  Trhde_20
ggatcctcttctgatagcgt

SEQ ID NO: 62820 - DNA, 20 bp, Artificial Sequence
  sgRNA
  Trhr_1
agatactgtcggttatgttg

SEQ ID NO: 62821 - DNA, 20 bp, Artificial Sequence
  sgRNA
  Trhr_2
ggtggttaccatcttacttg

SEQ ID NO: 62822 - DNA, 20 bp, Artificial Sequence
  sgRNA
  Trhr_3
cacctacaaaaacgctgttg

SEQ ID NO: 62823 - DNA, 20 bp, Artificial Sequence
  sgRNA
  Trhr_4
ctaaagaaaactctaagatg

SEQ ID NO: 62824 - DNA, 20 bp, Artificial Sequence
  sgRNA
  Trhr_5
ggtcaccaagatgctcgcag

SEQ ID NO: 62825 - DNA, 20 bp, Artificial Sequence
  sgRNA
  Trhr_6
ggtaaccacctggtactcga

SEQ ID NO: 62826 - DNA, 20 bp, Artificial Sequence
  sgRNA
  Trhr_7
tgctgatgttgagatccagc

SEQ ID NO: 62827 - DNA, 20 bp, Artificial Sequence
  sgRNA
  Trhr_8
gatgccctacaggactcttg

SEQ ID NO: 62828 - DNA, 20 bp, Artificial Sequence
  sgRNA
  Trhr_9
gccaacatagccatagaccc

SEQ ID NO: 62829 - DNA, 20 bp, Artificial Sequence
  sgRNA
  Trhr_10
ggaaaacgtgcagagaaact

SEQ ID NO: 62830 - DNA, 20 bp, Artificial Sequence
  sgRNA
  Trhr_11
tgacacatacgtatcggtga

SEQ ID NO: 62831 - DNA, 20 bp, Artificial Sequence
  sgRNA
  Trhr_12
ccaggaaccatagatactgt

SEQ ID NO: 62832 - DNA, 20 bp, Artificial Sequence
  sgRNA
  Trhr_13
agaaatttcgtgcagccttc

SEQ ID NO: 62833 - DNA, 20 bp, Artificial Sequence
  sgRNA
  Trhr_14
taccaggtaacagtttgtag

SEQ ID NO: 62834 - DNA, 20 bp, Artificial Sequence
  sgRNA
  Trhr_15
gattgctatgtacctttcaa

SEQ ID NO: 62835 - DNA, 20 bp, Artificial Sequence
  sgRNA
  Trhr_16
attacatatctccagtacct

SEQ ID NO: 62836 - DNA, 20 bp, Artificial Sequence
  sgRNA
  Trhr_17
tatgctctggttcttcctgc

SEQ ID NO: 62837 - DNA, 20 bp, Artificial Sequence
  sgRNA
  Trhr_18
ttacctggtaagtctggctg

SEQ ID NO: 62838 - DNA, 20 bp, Artificial Sequence
  sgRNA
  Trhr_19
gctttgttctcatgaccacc

SEQ ID NO: 62839 - DNA, 20 bp, Artificial Sequence
  sgRNA
  Trhr_20
gcaattgcagagcttcctga

SEQ ID NO: 62840 - DNA, 20 bp, Artificial Sequence
  sgRNA
  Tril_1
gcattaaggttgagccggcg

SEQ ID NO: 62841 - DNA, 20 bp, Artificial Sequence
  sgRNA
  Tril_2
acatctcctatgcaccaaca

SEQ ID NO: 62842 - DNA, 20 bp, Artificial Sequence
  sgRNA
  Tril_3
cgagaagctctcacgactag

SEQ ID NO: 62843 - DNA, 20 bp, Artificial Sequence
  sgRNA
  Tril_4
gctgcagaatgggtcttgcg

SEQ ID NO: 62844 - DNA, 20 bp, Artificial Sequence
  sgRNA
  Tril_5
gggttactaaccctgcgcag

SEQ ID NO: 62845 - DNA, 20 bp, Artificial Sequence
  sgRNA
  Tril_6
ggctcaaccttaatgcgctg

SEQ ID NO: 62846 - DNA, 20 bp, Artificial Sequence
  sgRNA
  Tril_7
acctacacctggaatctaac

SEQ ID NO: 62847 - DNA, 20 bp, Artificial Sequence
  sgRNA
  Tril_8
gccacatgtactccacccga

SEQ ID NO: 62848 - DNA, 20 bp, Artificial Sequence
  sgRNA
  Tril_9
ttgcgcatcctttacgccaa

SEQ ID NO: 62849 - DNA, 20 bp, Artificial Sequence
  sgRNA
  Tril_10
tgtccatgaagcggtcgcag

SEQ ID NO: 62850 - DNA, 20 bp, Artificial Sequence
  sgRNA
  Tril_11
atccaggtacttgccccgca

SEQ ID NO: 62851 - DNA, 20 bp, Artificial Sequence
  sgRNA
  Tril_12
actgcacgaagaccgtaagg

SEQ ID NO: 62852 - DNA, 20 bp, Artificial Sequence
  sgRNA
  Tril_13
caccccctacctagtatgcg

SEQ ID NO: 62853 - DNA, 20 bp, Artificial Sequence
  sgRNA
  Tril_14
aggcgttcttgcccaaaaaa

SEQ ID NO: 62854 - DNA, 20 bp, Artificial Sequence
  sgRNA
  Tril_15
tagtcgtgagagcttctcga

SEQ ID NO: 62855 - DNA, 20 bp, Artificial Sequence
  sgRNA
  Tril_16
gctcacgcacctcgccccag

SEQ ID NO: 62856 - DNA, 20 bp, Artificial Sequence
  sgRNA
  Tril_17
ttccaggcgcagctcacgta

SEQ ID NO: 62857 - DNA, 20 bp, Artificial Sequence
  sgRNA
  Tril_18
tggcaaaccaaccccactaa

SEQ ID NO: 62858 - DNA, 20 bp, Artificial Sequence
  sgRNA
  Tril_19
gcacaccctccacgcatact

SEQ ID NO: 62859 - DNA, 20 bp, Artificial Sequence
  sgRNA
  Tril_20
catgtggcgaacgtggaccg

SEQ ID NO: 62860 - DNA, 20 bp, Artificial Sequence
  sgRNA
  Trp53i13_1
ccggtcgccttacctcgcga

SEQ ID NO: 62861 - DNA, 20 bp, Artificial Sequence
  sgRNA
  Trp53i13_2
cccagtcgttaaggagaccg

SEQ ID NO: 62862 - DNA, 20 bp, Artificial Sequence
  sgRNA
  Trp53i13_3
accaagagtgacttacacac

SEQ ID NO: 62863 - DNA, 20 bp, Artificial Sequence
  sgRNA
  Trp53i13_4
tgacatctagaggatccggg

SEQ ID NO: 62864 - DNA, 20 bp, Artificial Sequence
  sgRNA
  Trp53i13_5
ggagcgagagtatctattgg

SEQ ID NO: 62865 - DNA, 20 bp, Artificial Sequence
  sgRNA
  Trp53i13_6
ggattaccaacagcactgga

SEQ ID NO: 62866 - DNA, 20 bp, Artificial Sequence
  sgRNA
  Trp53i13_7
gagtatctattgggggccca

SEQ ID NO: 62867 - DNA, 20 bp, Artificial Sequence
  sgRNA
  Trp53i13_8
ggggctcctgagccttcgcg

SEQ ID NO: 62868 - DNA, 20 bp, Artificial Sequence
  sgRNA
  Trp53i13_9
agggctaccagaagcaaccg

SEQ ID NO: 62869 - DNA, 20 bp, Artificial Sequence
  sgRNA
  Trp53i13_10
gatgtcacctgtgcaccagg

SEQ ID NO: 62870 - DNA, 20 bp, Artificial Sequence
  sgRNA
  Trp53i13_11
ggtgggccaagagtgcaagc

SEQ ID NO: 62871 - DNA, 20 bp, Artificial Sequence
  sgRNA
  Trp53i13_12
gcctcactcgcaatgtactg

SEQ ID NO: 62872 - DNA, 20 bp, Artificial Sequence
  sgRNA
  Trp53i13_13
gggcttagccacatacaggt

SEQ ID NO: 62873 - DNA, 20 bp, Artificial Sequence
  sgRNA
  Trp53i13_14
gcaggagcgagagtatctat

SEQ ID NO: 62874 - DNA, 20 bp, Artificial Sequence
  sgRNA
  Trp53i13_15
tcctgacttcagtctcacgt

SEQ ID NO: 62875 - DNA, 20 bp, Artificial Sequence
  sgRNA
  Trp53i13_16
actggctgaagaggcagcgg

SEQ ID NO: 62876 - DNA, 20 bp, Artificial Sequence
  sgRNA
  Trp53i13_17
gactgcaccggaatttccgc

SEQ ID NO: 62877 - DNA, 20 bp, Artificial Sequence
  sgRNA
  Trp53i13_18
ttaacgactgggggacctgg

SEQ ID NO: 62878 - DNA, 20 bp, Artificial Sequence
  sgRNA
  Trp53i13_19
tcgccagctccgtagagcaa

SEQ ID NO: 62879 - DNA, 20 bp, Artificial Sequence
  sgRNA
  Trp53i13_20
ttcctgacttcagtctcacg

SEQ ID NO: 62880 - DNA, 20 bp, Artificial Sequence
  sgRNA
  Trpv2_1
tgcaccgatgagttctaccg

SEQ ID NO: 62881 - DNA, 20 bp, Artificial Sequence
  sgRNA
  Trpv2_2
ccgtgaccgactcttcagtg

SEQ ID NO: 62882 - DNA, 20 bp, Artificial Sequence
  sgRNA
  Trpv2_3
tgacagccttctccaaatgg

SEQ ID NO: 62883 - DNA, 20 bp, Artificial Sequence
  sgRNA
  Trpv2_4
tttcccgaaagttcaccgag

SEQ ID NO: 62884 - DNA, 20 bp, Artificial Sequence
  sgRNA
  Trpv2_5
gacaggaccgtagcaccact

SEQ ID NO: 62885 - DNA, 20 bp, Artificial Sequence
  sgRNA
  Trpv2_6
gatggatcctcagataaggt

SEQ ID NO: 62886 - DNA, 20 bp, Artificial Sequence
  sgRNA
  Trpv2_7
ggtgcactgggcattgacaa

SEQ ID NO: 62887 - DNA, 20 bp, Artificial Sequence
  sgRNA
  Trpv2_8
ttagtgtcatccctagtgct

SEQ ID NO: 62888 - DNA, 20 bp, Artificial Sequence
  sgRNA
  Trpv2_9
agtgaatctcaactaccgaa

SEQ ID NO: 62889 - DNA, 20 bp, Artificial Sequence
  sgRNA
  Trpv2_10
ggaaaaggcatcgcgcaggg

SEQ ID NO: 62890 - DNA, 20 bp, Artificial Sequence
  sgRNA
  Trpv2_11
gtggctctaaaaccaccatg

SEQ ID NO: 62891 - DNA, 20 bp, Artificial Sequence
  sgRNA
  Trpv2_12
gctgaaagttggcaccaaag

SEQ ID NO: 62892 - DNA, 20 bp, Artificial Sequence
  sgRNA
  Trpv2_13
actagggatgacactaacag

SEQ ID NO: 62893 - DNA, 20 bp, Artificial Sequence
  sgRNA
  Trpv2_14
tctccagcctaaaagctggg

SEQ ID NO: 62894 - DNA, 20 bp, Artificial Sequence
  sgRNA
  Trpv2_15
ggaggaaaaggcatcgcgca

SEQ ID NO: 62895 - DNA, 20 bp, Artificial Sequence
  sgRNA
  Trpv2_16
acaggtcgtacagtgacact

SEQ ID NO: 62896 - DNA, 20 bp, Artificial Sequence
  sgRNA
  Trpv2_17
cctagtaagcttgagccggg

SEQ ID NO: 62897 - DNA, 20 bp, Artificial Sequence
  sgRNA
  Trpv2_18
gccgctgctgcagattgaca

SEQ ID NO: 62898 - DNA, 20 bp, Artificial Sequence
  sgRNA
  Trpv2_19
agaacccaacctctaaacct

SEQ ID NO: 62899 - DNA, 20 bp, Artificial Sequence
  sgRNA
  Trpv2_20
gtatgacagccttctccaaa

SEQ ID NO: 62900 - DNA, 20 bp, Artificial Sequence
  sgRNA
  Trpv4_1
tcagcacatcatccgacgtg

SEQ ID NO: 62901 - DNA, 20 bp, Artificial Sequence
  sgRNA
  Trpv4_2
ggtgtacaacagcaagatcg

SEQ ID NO: 62902 - DNA, 20 bp, Artificial Sequence
  sgRNA
  Trpv4_3
ctcacaagaaagctgacatg

SEQ ID NO: 62903 - DNA, 20 bp, Artificial Sequence
  sgRNA
  Trpv4_4
ctacccttaccggaccacag

SEQ ID NO: 62904 - DNA, 20 bp, Artificial Sequence
  sgRNA
  Trpv4_5
cctcatctgtcacctcacgt

SEQ ID NO: 62905 - DNA, 20 bp, Artificial Sequence
  sgRNA
  Trpv4_6
ttgttcagctccactacgcg

SEQ ID NO: 62906 - DNA, 20 bp, Artificial Sequence
  sgRNA
  Trpv4_7
tggtacccctggataaccta

SEQ ID NO: 62907 - DNA, 20 bp, Artificial Sequence
  sgRNA
  Trpv4_8
agggcggctagcatccaccg

SEQ ID NO: 62908 - DNA, 20 bp, Artificial Sequence
  sgRNA
  Trpv4_9
gcgctgctgaacctaagcaa

SEQ ID NO: 62909 - DNA, 20 bp, Artificial Sequence
  sgRNA
  Trpv4_10
tgttggtgcacggattcagg

SEQ ID NO: 62910 - DNA, 20 bp, Artificial Sequence
  sgRNA
  Trpv4_11
atgcgctgtacttcacgcgc

SEQ ID NO: 62911 - DNA, 20 bp, Artificial Sequence
  sgRNA
  Trpv4_12
catgaggcgacaggactcga

SEQ ID NO: 62912 - DNA, 20 bp, Artificial Sequence
  sgRNA
  Trpv4_13
atggcttctcccacaccgtg

SEQ ID NO: 62913 - DNA, 20 bp, Artificial Sequence
  sgRNA
  Trpv4_14
tgtgtccttctacatcaacg

SEQ ID NO: 62914 - DNA, 20 bp, Artificial Sequence
  sgRNA
  Trpv4_15
gtaagtgccgtagtcgaaca

SEQ ID NO: 62915 - DNA, 20 bp, Artificial Sequence
  sgRNA
  Trpv4_16
gcactactgaggactcgtac

SEQ ID NO: 62916 - DNA, 20 bp, Artificial Sequence
  sgRNA
  Trpv4_17
agtccactgtggtccggtaa

SEQ ID NO: 62917 - DNA, 20 bp, Artificial Sequence
  sgRNA
  Trpv4_18
cactacgcggggcaccaccg

SEQ ID NO: 62918 - DNA, 20 bp, Artificial Sequence
  sgRNA
  Trpv4_19
tgtgggagaagccatagtac

SEQ ID NO: 62919 - DNA, 20 bp, Artificial Sequence
  sgRNA
  Trpv4_20
cactactgaggactcgtaca

SEQ ID NO: 62920 - DNA, 20 bp, Artificial Sequence
  sgRNA
  Trpv5_1
tgtttgtccaaagtagcgag

SEQ ID NO: 62921 - DNA, 20 bp, Artificial Sequence
  sgRNA
  Trpv5_2
agaaacggaagcgcatccag

SEQ ID NO: 62922 - DNA, 20 bp, Artificial Sequence
  sgRNA
  Trpv5_3
gtgtgaacttcgatggaagg

SEQ ID NO: 62923 - DNA, 20 bp, Artificial Sequence
  sgRNA
  Trpv5_4
tacaaatggctcacacagtg

SEQ ID NO: 62924 - DNA, 20 bp, Artificial Sequence
  sgRNA
  Trpv5_5
ttaccaggataagatccggc

SEQ ID NO: 62925 - DNA, 20 bp, Artificial Sequence
  sgRNA
  Trpv5_6
agtgtcatgtacttcgcccg

SEQ ID NO: 62926 - DNA, 20 bp, Artificial Sequence
  sgRNA
  Trpv5_7
gatgtagtcctggacaaagg

SEQ ID NO: 62927 - DNA, 20 bp, Artificial Sequence
  sgRNA
  Trpv5_8
ccaagactggaaccagcacg

SEQ ID NO: 62928 - DNA, 20 bp, Artificial Sequence
  sgRNA
  Trpv5_9
gcttaccaatgtgaatggcg

SEQ ID NO: 62929 - DNA, 20 bp, Artificial Sequence
  sgRNA
  Trpv5_10
tgttatctcgaacatgtgta

SEQ ID NO: 62930 - DNA, 20 bp, Artificial Sequence
  sgRNA
  Trpv5_11
aggtgctgaacattgctgtg

SEQ ID NO: 62931 - DNA, 20 bp, Artificial Sequence
  sgRNA
  Trpv5_12
ctaagcagcaatagccaccg

SEQ ID NO: 62932 - DNA, 20 bp, Artificial Sequence
  sgRNA
  Trpv5_13
tcaccaactccccgaccagc

SEQ ID NO: 62933 - DNA, 20 bp, Artificial Sequence
  sgRNA
  Trpv5_14
cactacctcgccattcacat

SEQ ID NO: 62934 - DNA, 20 bp, Artificial Sequence
  sgRNA
  Trpv5_15
gtaagaaccaacggtctccc

SEQ ID NO: 62935 - DNA, 20 bp, Artificial Sequence
  sgRNA
  Trpv5_16
actacaccagcccagcacca

SEQ ID NO: 62936 - DNA, 20 bp, Artificial Sequence
  sgRNA
  Trpv5_17
aatacggcctgggagaccgt

SEQ ID NO: 62937 - DNA, 20 bp, Artificial Sequence
  sgRNA
  Trpv5_18
tgctctgtacatcttctaca

SEQ ID NO: 62938 - DNA, 20 bp, Artificial Sequence
  sgRNA
  Trpv5_19
gataaggattctgctcctgg

SEQ ID NO: 62939 - DNA, 20 bp, Artificial Sequence
  sgRNA
  Trpv5_20
catagtcagtagcacaaggg

SEQ ID NO: 62940 - DNA, 20 bp, Artificial Sequence
  sgRNA
  Trpv6_1
tttggacagaccattctcgg

SEQ ID NO: 62941 - DNA, 20 bp, Artificial Sequence
  sgRNA
  Trpv6_2
gctcaagtttgaaggatgtg

SEQ ID NO: 62942 - DNA, 20 bp, Artificial Sequence
  sgRNA
  Trpv6_3
tgttactaccaagaaacggg

SEQ ID NO: 62943 - DNA, 20 bp, Artificial Sequence
  sgRNA
  Trpv6_4
gaacttgtgccaaataacca

SEQ ID NO: 62944 - DNA, 20 bp, Artificial Sequence
  sgRNA
  Trpv6_5
ggaaggcctgtgcatagcgg

SEQ ID NO: 62945 - DNA, 20 bp, Artificial Sequence
  sgRNA
  Trpv6_6
tggccctgccaactatgacg

SEQ ID NO: 62946 - DNA, 20 bp, Artificial Sequence
  sgRNA
  Trpv6_7
tccgtgctctgcttgcccga

SEQ ID NO: 62947 - DNA, 20 bp, Artificial Sequence
  sgRNA
  Trpv6_8
cgagttcccccaccaaccgg

SEQ ID NO: 62948 - DNA, 20 bp, Artificial Sequence
  sgRNA
  Trpv6_9
attggtgagtcgcatcacca

SEQ ID NO: 62949 - DNA, 20 bp, Artificial Sequence
  sgRNA
  Trpv6_10
gcatcagagtgttgtcccgg

SEQ ID NO: 62950 - DNA, 20 bp, Artificial Sequence
  sgRNA
  Trpv6_11
ccagagctcatctcgctcat

SEQ ID NO: 62951 - DNA, 20 bp, Artificial Sequence
  sgRNA
  Trpv6_12
ttggacagaccattctcggg

SEQ ID NO: 62952 - DNA, 20 bp, Artificial Sequence
  sgRNA
  Trpv6_13
tcatttctatgactacccca

SEQ ID NO: 62953 - DNA, 20 bp, Artificial Sequence
  sgRNA
  Trpv6_14
gcacccagcacgcagaagta

SEQ ID NO: 62954 - DNA, 20 bp, Artificial Sequence
  sgRNA
  Trpv6_15
gatccacgtcatagttggca

SEQ ID NO: 62955 - DNA, 20 bp, Artificial Sequence
  sgRNA
  Trpv6_16
ggggtgccaatgtggcccca

SEQ ID NO: 62956 - DNA, 20 bp, Artificial Sequence
  sgRNA
  Trpv6_17
gatgcaacagaagctccttc

SEQ ID NO: 62957 - DNA, 20 bp, Artificial Sequence
  sgRNA
  Trpv6_18
ccaccactgtgatgttagag

SEQ ID NO: 62958 - DNA, 20 bp, Artificial Sequence
  sgRNA
  Trpv6_19
tgcatcagagtgttgtcccg

SEQ ID NO: 62959 - DNA, 20 bp, Artificial Sequence
  sgRNA
  Trpv6_20
aggtgctgaacagtgccatg

SEQ ID NO: 62960 - DNA, 20 bp, Artificial Sequence
  sgRNA
  Tshr_1
actacaaattgaccgtgccg

SEQ ID NO: 62961 - DNA, 20 bp, Artificial Sequence
  sgRNA
  Tshr_2
tggaggaaactcaacgacag

SEQ ID NO: 62962 - DNA, 20 bp, Artificial Sequence
  sgRNA
  Tshr_3
agactcgaaaatgcaagact

SEQ ID NO: 62963 - DNA, 20 bp, Artificial Sequence
  sgRNA
  Tshr_4
aaatcagtgaacatcttgag

SEQ ID NO: 62964 - DNA, 20 bp, Artificial Sequence
  sgRNA
  Tshr_5
gatggcgtaccatcgctcca

SEQ ID NO: 62965 - DNA, 20 bp, Artificial Sequence
  sgRNA
  Tshr_6
gacgggccctgggtgcaaca

SEQ ID NO: 62966 - DNA, 20 bp, Artificial Sequence
  sgRNA
  Tshr_7
tttcaccaaggccttccaga

SEQ ID NO: 62967 - DNA, 20 bp, Artificial Sequence
  sgRNA
  Tshr_8
cagggaccgaagtcatgtaa

SEQ ID NO: 62968 - DNA, 20 bp, Artificial Sequence
  sgRNA
  Tshr_9
gttaaactcgtccgacttgg

SEQ ID NO: 62969 - DNA, 20 bp, Artificial Sequence
  sgRNA
  Tshr_10
gcaggacgaagatattgccc

SEQ ID NO: 62970 - DNA, 20 bp, Artificial Sequence
  sgRNA
  Tshr_11
actacaaccacgccatcgac

SEQ ID NO: 62971 - DNA, 20 bp, Artificial Sequence
  sgRNA
  Tshr_12
gtccctgaaaacgcattcca

SEQ ID NO: 62972 - DNA, 20 bp, Artificial Sequence
  sgRNA
  Tshr_13
gtatccggaaccttcgtcaa

SEQ ID NO: 62973 - DNA, 20 bp, Artificial Sequence
  sgRNA
  Tshr_14
ctatagatgcaactctgcag

SEQ ID NO: 62974 - DNA, 20 bp, Artificial Sequence
  sgRNA
  Tshr_15
ctatgactacacggtgtgtg

SEQ ID NO: 62975 - DNA, 20 bp, Artificial Sequence
  sgRNA
  Tshr_16
ggttcttaaaagcgcagcag

SEQ ID NO: 62976 - DNA, 20 bp, Artificial Sequence
  sgRNA
  Tshr_17
ggagtttccaagcagttcat

SEQ ID NO: 62977 - DNA, 20 bp, Artificial Sequence
  sgRNA
  Tshr_18
ggttcctgagaatcgtggtg

SEQ ID NO: 62978 - DNA, 20 bp, Artificial Sequence
  sgRNA
  Tshr_19
atagagaaacggattggcac

SEQ ID NO: 62979 - DNA, 20 bp, Artificial Sequence
  sgRNA
  Tshr_20
gagttagtaacagtgattag

SEQ ID NO: 62980 - DNA, 20 bp, Artificial Sequence
  sgRNA
  Tspan1_1
tggtgtacaccacattggtg

SEQ ID NO: 62981 - DNA, 20 bp, Artificial Sequence
  sgRNA
  Tspan1_2
caggaaagatgtcccatcga

SEQ ID NO: 62982 - DNA, 20 bp, Artificial Sequence
  sgRNA
  Tspan1_3
gccatgcagtttgtcaacgt

SEQ ID NO: 62983 - DNA, 20 bp, Artificial Sequence
  sgRNA
  Tspan1_4
gaacaagtgtgtgctcatga

SEQ ID NO: 62984 - DNA, 20 bp, Artificial Sequence
  sgRNA
  Tspan1_5
attctctttgacgaaacgtg

SEQ ID NO: 62985 - DNA, 20 bp, Artificial Sequence
  sgRNA
  Tspan1_6
ccaagtatggaacactacaa

SEQ ID NO: 62986 - DNA, 20 bp, Artificial Sequence
  sgRNA
  Tspan1_7
ccagattcccacagccaaca

SEQ ID NO: 62987 - DNA, 20 bp, Artificial Sequence
  sgRNA
  Tspan1_8
aatgaagagcacagcaccag

SEQ ID NO: 62988 - DNA, 20 bp, Artificial Sequence
  sgRNA
  Tspan1_9
acaattcctgacactcctgg

SEQ ID NO: 62989 - DNA, 20 bp, Artificial Sequence
  sgRNA
  Tspan1_10
cgatgggacatctttcctga

SEQ ID NO: 62990 - DNA, 20 bp, Artificial Sequence
  sgRNA
  Tspan1_11
tttcgatagcaggcaccacc

SEQ ID NO: 62991 - DNA, 20 bp, Artificial Sequence
  sgRNA
  Tspan1_12
gccaatgcagtcactgtggg

SEQ ID NO: 62992 - DNA, 20 bp, Artificial Sequence
  sgRNA
  Tspan1_13
cctgctatcgaaaaagacta

SEQ ID NO: 62993 - DNA, 20 bp, Artificial Sequence
  sgRNA
  Tspan1_14
ttgccagggttggcacaaca

SEQ ID NO: 62994 - DNA, 20 bp, Artificial Sequence
  sgRNA
  Tspan1_15
gttcaactgtatggttgcca

SEQ ID NO: 62995 - DNA, 20 bp, Artificial Sequence
  sgRNA
  Tspan1_16
cattgtagtgttccatactt

SEQ ID NO: 62996 - DNA, 20 bp, Artificial Sequence
  sgRNA
  Tspan1_17
tacagttgaaccatgcaccg

SEQ ID NO: 62997 - DNA, 20 bp, Artificial Sequence
  sgRNA
  Tspan1_18
cggtgcatggttcaactgta

SEQ ID NO: 62998 - DNA, 20 bp, Artificial Sequence
  sgRNA
  Tspan1_19
tagatacatggatacaacca

SEQ ID NO: 62999 - DNA, 20 bp, Artificial Sequence
  sgRNA
  Tspan1_20
gcccacgttgacaaactgca

SEQ ID NO: 63000 - DNA, 20 bp, Artificial Sequence
  sgRNA
  Tspan11_1
caccagtgtccagataccca

SEQ ID NO: 63001 - DNA, 20 bp, Artificial Sequence
  sgRNA
  Tspan11_2
gaagagcaggtacttcaggt

SEQ ID NO: 63002 - DNA, 20 bp, Artificial Sequence
  sgRNA
  Tspan11_3
agaggcagcgaacgtgctgg

SEQ ID NO: 63003 - DNA, 20 bp, Artificial Sequence
  sgRNA
  Tspan11_4
gggggacactcactgtggag

SEQ ID NO: 63004 - DNA, 20 bp, Artificial Sequence
  sgRNA
  Tspan11_5
ccacccctccaacatctaca

SEQ ID NO: 63005 - DNA, 20 bp, Artificial Sequence
  sgRNA
  Tspan11_6
gtacgcgctgtgctgccagt

SEQ ID NO: 63006 - DNA, 20 bp, Artificial Sequence
  sgRNA
  Tspan11_7
tgagcactacggacagccca

SEQ ID NO: 63007 - DNA, 20 bp, Artificial Sequence
  sgRNA
  Tspan11_8
tggcacatgtgtactaccag

SEQ ID NO: 63008 - DNA, 20 bp, Artificial Sequence
  sgRNA
  Tspan11_9
gcagtaacagctcagccgac

SEQ ID NO: 63009 - DNA, 20 bp, Artificial Sequence
  sgRNA
  Tspan11_10
gctgctggtcatcttccttg

SEQ ID NO: 63010 - DNA, 20 bp, Artificial Sequence
  sgRNA
  Tspan11_11
ggccgcagagatcacagcct

SEQ ID NO: 63011 - DNA, 20 bp, Artificial Sequence
  sgRNA
  Tspan11_12
gcaagacagagcaggatgac

SEQ ID NO: 63012 - DNA, 20 bp, Artificial Sequence
  sgRNA
  Tspan11_13
gctgaccacctgctgctcat

SEQ ID NO: 63013 - DNA, 20 bp, Artificial Sequence
  sgRNA
  Tspan11_14
ccagatacccacggccatga

SEQ ID NO: 63014 - DNA, 20 bp, Artificial Sequence
  sgRNA
  Tspan11_15
tctaccttgtagatgttgga

SEQ ID NO: 63015 - DNA, 20 bp, Artificial Sequence
  sgRNA
  Tspan11_16
ggccaagctggaacagttcg

SEQ ID NO: 63016 - DNA, 20 bp, Artificial Sequence
  sgRNA
  Tspan11_17
ggatgatggccccaaagccc

SEQ ID NO: 63017 - DNA, 20 bp, Artificial Sequence
  sgRNA
  Tspan11_18
cccctgccaccagctccaca

SEQ ID NO: 63018 - DNA, 20 bp, Artificial Sequence
  sgRNA
  Tspan11_19
cgacagctgctgcaagacag

SEQ ID NO: 63019 - DNA, 20 bp, Artificial Sequence
  sgRNA
  Tspan11_20
ctgctgcagccggtccaccg

SEQ ID NO: 63020 - DNA, 20 bp, Artificial Sequence
  sgRNA
  Tspan13_1
agctccaattagccccacca

SEQ ID NO: 63021 - DNA, 20 bp, Artificial Sequence
  sgRNA
  Tspan13_2
ggctactcacggtatacagc

SEQ ID NO: 63022 - DNA, 20 bp, Artificial Sequence
  sgRNA
  Tspan13_3
caatgaccacacccaccact

SEQ ID NO: 63023 - DNA, 20 bp, Artificial Sequence
  sgRNA
  Tspan13_4
actggacaataaatacaagt

SEQ ID NO: 63024 - DNA, 20 bp, Artificial Sequence
  sgRNA
  Tspan13_5
tgtaggtcagccaaacaccc

SEQ ID NO: 63025 - DNA, 20 bp, Artificial Sequence
  sgRNA
  Tspan13_6
agcatactctccgattatgg

SEQ ID NO: 63026 - DNA, 20 bp, Artificial Sequence
  sgRNA
  Tspan13_7
tggagctgtaaaacaccacc

SEQ ID NO: 63027 - DNA, 20 bp, Artificial Sequence
  sgRNA
  Tspan13_8
gtcagctgctggaagtcgga

SEQ ID NO: 63028 - DNA, 20 bp, Artificial Sequence
  sgRNA
  Tspan13_9
gctgatctccagtctccgag

SEQ ID NO: 63029 - DNA, 20 bp, Artificial Sequence
  sgRNA
  Tspan13_10
ttagccccaccaaggcaatc

SEQ ID NO: 63030 - DNA, 20 bp, Artificial Sequence
  sgRNA
  Tspan13_11
tgtcatttgggttatagctc

SEQ ID NO: 63031 - DNA, 20 bp, Artificial Sequence
  sgRNA
  Tspan13_12
aaagcactcgggttggcgcg

SEQ ID NO: 63032 - DNA, 20 bp, Artificial Sequence
  sgRNA
  Tspan13_13
tgttcctgattgccttggtg

SEQ ID NO: 63033 - DNA, 20 bp, Artificial Sequence
  sgRNA
  Tspan13_14
tccagctctagcctcttcgt

SEQ ID NO: 63034 - DNA, 20 bp, Artificial Sequence
  sgRNA
  Tspan13_15
tccgattatgggggcgcacg

SEQ ID NO: 63035 - DNA, 20 bp, Artificial Sequence
  sgRNA
  Tspan13_16
gtgctcgaaatgacatccag

SEQ ID NO: 63036 - DNA, 20 bp, Artificial Sequence
  sgRNA
  Tspan13_17
tcctcgtgcgcccccataat

SEQ ID NO: 63037 - DNA, 20 bp, Artificial Sequence
  sgRNA
  Tspan13_18
aagcactcgggttggcgcga

SEQ ID NO: 63038 - DNA, 20 bp, Artificial Sequence
  sgRNA
  Tspan13_19
gcctcttcgtcggaagtcct

SEQ ID NO: 63039 - DNA, 20 bp, Artificial Sequence
  sgRNA
  Tspan13_20
atctccagtctccgagtggt

SEQ ID NO: 63040 - DNA, 20 bp, Artificial Sequence
  sgRNA
  Tspan14_1
ggggtcgattccatgcaacc

SEQ ID NO: 63041 - DNA, 20 bp, Artificial Sequence
  sgRNA
  Tspan14_2
caggtcgatgtcatcccgat

SEQ ID NO: 63042 - DNA, 20 bp, Artificial Sequence
  sgRNA
  Tspan14_3
taatttcagaatcagtgctg

SEQ ID NO: 63043 - DNA, 20 bp, Artificial Sequence
  sgRNA
  Tspan14_4
ttggaataaaaaggccaaca

SEQ ID NO: 63044 - DNA, 20 bp, Artificial Sequence
  sgRNA
  Tspan14_5
ttatagatactcgaacgccg

SEQ ID NO: 63045 - DNA, 20 bp, Artificial Sequence
  sgRNA
  Tspan14_6
ccatcaagaccagcacgacg

SEQ ID NO: 63046 - DNA, 20 bp, Artificial Sequence
  sgRNA
  Tspan14_7
agagcaacatcaagtcctat

SEQ ID NO: 63047 - DNA, 20 bp, Artificial Sequence
  sgRNA
  Tspan14_8
ggatgcatccaggctctgga

SEQ ID NO: 63048 - DNA, 20 bp, Artificial Sequence
  sgRNA
  Tspan14_9
gccacaatgtagatgttcct

SEQ ID NO: 63049 - DNA, 20 bp, Artificial Sequence
  sgRNA
  Tspan14_10
tgtgctgtccgacctcacca

SEQ ID NO: 63050 - DNA, 20 bp, Artificial Sequence
  sgRNA
  Tspan14_11
caccatcaagaccagcacga

SEQ ID NO: 63051 - DNA, 20 bp, Artificial Sequence
  sgRNA
  Tspan14_12
gctacagccgagagaaatgt

SEQ ID NO: 63052 - DNA, 20 bp, Artificial Sequence
  sgRNA
  Tspan14_13
gctggtcttgatggtgggcg

SEQ ID NO: 63053 - DNA, 20 bp, Artificial Sequence
  sgRNA
  Tspan14_14
aggaacatctacattgtggc

SEQ ID NO: 63054 - DNA, 20 bp, Artificial Sequence
  sgRNA
  Tspan14_15
gtcgtgctggtcttgatggt

SEQ ID NO: 63055 - DNA, 20 bp, Artificial Sequence
  sgRNA
  Tspan14_16
tctcgaagaattcccggaac

SEQ ID NO: 63056 - DNA, 20 bp, Artificial Sequence
  sgRNA
  Tspan14_17
gggcgtggtgatgttcacac

SEQ ID NO: 63057 - DNA, 20 bp, Artificial Sequence
  sgRNA
  Tspan14_18
ggagttgtcttccttggagt

SEQ ID NO: 63058 - DNA, 20 bp, Artificial Sequence
  sgRNA
  Tspan14_19
gatgagttcatctttacaaa

SEQ ID NO: 63059 - DNA, 20 bp, Artificial Sequence
  sgRNA
  Tspan14_20
ctacagccgagagaaatgtg

SEQ ID NO: 63060 - DNA, 20 bp, Artificial Sequence
  sgRNA
  Tspan15_1
ctgaacgacaacatccggag

SEQ ID NO: 63061 - DNA, 20 bp, Artificial Sequence
  sgRNA
  Tspan15_2
atcactcacccagaacacgg

SEQ ID NO: 63062 - DNA, 20 bp, Artificial Sequence
  sgRNA
  Tspan15_3
gtcagtggggatctacgcag

SEQ ID NO: 63063 - DNA, 20 bp, Artificial Sequence
  sgRNA
  Tspan15_4
ctggtcatggagcttattgg

SEQ ID NO: 63064 - DNA, 20 bp, Artificial Sequence
  sgRNA
  Tspan15_5
tgaacatgaccacccccagg

SEQ ID NO: 63065 - DNA, 20 bp, Artificial Sequence
  sgRNA
  Tspan15_6
cagaacatcattcacgtgcg

SEQ ID NO: 63066 - DNA, 20 bp, Artificial Sequence
  sgRNA
  Tspan15_7
ccaagataatgtcctccaca

SEQ ID NO: 63067 - DNA, 20 bp, Artificial Sequence
  sgRNA
  Tspan15_8
cgatgaacatgaccaccccc

SEQ ID NO: 63068 - DNA, 20 bp, Artificial Sequence
  sgRNA
  Tspan15_9
gcaggtgtagggcaccccgc

SEQ ID NO: 63069 - DNA, 20 bp, Artificial Sequence
  sgRNA
  Tspan15_10
cctactgtacatcacccgtg

SEQ ID NO: 63070 - DNA, 20 bp, Artificial Sequence
  sgRNA
  Tspan15_11
ggccaggaaggcactctcca

SEQ ID NO: 63071 - DNA, 20 bp, Artificial Sequence
  sgRNA
  Tspan15_12
aaggcacaggttgtcccgga

SEQ ID NO: 63072 - DNA, 20 bp, Artificial Sequence
  sgRNA
  Tspan15_13
actttctgaacgacaacatc

SEQ ID NO: 63073 - DNA, 20 bp, Artificial Sequence
  sgRNA
  Tspan15_14
gttcatcgtctccttcatcg

SEQ ID NO: 63074 - DNA, 20 bp, Artificial Sequence
  sgRNA
  Tspan15_15
gtccatgaaccatatcaaca

SEQ ID NO: 63075 - DNA, 20 bp, Artificial Sequence
  sgRNA
  Tspan15_16
ggatctacgcagaggcagag

SEQ ID NO: 63076 - DNA, 20 bp, Artificial Sequence
  sgRNA
  Tspan15_17
ggacaactataccatcatgg

SEQ ID NO: 63077 - DNA, 20 bp, Artificial Sequence
  sgRNA
  Tspan15_18
gaaccatatcaacacggcgt

SEQ ID NO: 63078 - DNA, 20 bp, Artificial Sequence
  sgRNA
  Tspan15_19
agtaattctcgattcctctc

SEQ ID NO: 63079 - DNA, 20 bp, Artificial Sequence
  sgRNA
  Tspan15_20
catcatcctcatcctcctgg

SEQ ID NO: 63080 - DNA, 20 bp, Artificial Sequence
  sgRNA
  Tspan17_1
tcggcgctgacagatctggg

SEQ ID NO: 63081 - DNA, 20 bp, Artificial Sequence
  sgRNA
  Tspan17_2
aaggtcgagatcatcccggt

SEQ ID NO: 63082 - DNA, 20 bp, Artificial Sequence
  sgRNA
  Tspan17_3
ggtcttgctgtggtgcccga

SEQ ID NO: 63083 - DNA, 20 bp, Artificial Sequence
  sgRNA
  Tspan17_4
gatccaatccttgaagacga

SEQ ID NO: 63084 - DNA, 20 bp, Artificial Sequence
  sgRNA
  Tspan17_5
ccgccttgatgtcactcacg

SEQ ID NO: 63085 - DNA, 20 bp, Artificial Sequence
  sgRNA
  Tspan17_6
acaagacaacctgatcgtgg

SEQ ID NO: 63086 - DNA, 20 bp, Artificial Sequence
  sgRNA
  Tspan17_7
ccaccacaaacagccacacg

SEQ ID NO: 63087 - DNA, 20 bp, Artificial Sequence
  sgRNA
  Tspan17_8
tgggcggtcttgaccccgtg

SEQ ID NO: 63088 - DNA, 20 bp, Artificial Sequence
  sgRNA
  Tspan17_9
cccttctcaccagtttgagt

SEQ ID NO: 63089 - DNA, 20 bp, Artificial Sequence
  sgRNA
  Tspan17_10
acaacaatgtcaaagcctac

SEQ ID NO: 63090 - DNA, 20 bp, Artificial Sequence
  sgRNA
  Tspan17_11
gctacaagacaacctgatcg

SEQ ID NO: 63091 - DNA, 20 bp, Artificial Sequence
  sgRNA
  Tspan17_12
ctatgacatccgactcaaac

SEQ ID NO: 63092 - DNA, 20 bp, Artificial Sequence
  sgRNA
  Tspan17_13
tcttcctggagctggccgcg

SEQ ID NO: 63093 - DNA, 20 bp, Artificial Sequence
  sgRNA
  Tspan17_14
ccaaggctgtacctggagga

SEQ ID NO: 63094 - DNA, 20 bp, Artificial Sequence
  sgRNA
  Tspan17_15
tcccgcagcagccgacctca

SEQ ID NO: 63095 - DNA, 20 bp, Artificial Sequence
  sgRNA
  Tspan17_16
cctcgtgagtgacatcaagg

SEQ ID NO: 63096 - DNA, 20 bp, Artificial Sequence
  sgRNA
  Tspan17_17
tcggatgtcatagccacact

SEQ ID NO: 63097 - DNA, 20 bp, Artificial Sequence
  sgRNA
  Tspan17_18
ccagcaattccaggaccctg

SEQ ID NO: 63098 - DNA, 20 bp, Artificial Sequence
  sgRNA
  Tspan17_19
ccagctccaggaagaagatg

SEQ ID NO: 63099 - DNA, 20 bp, Artificial Sequence
  sgRNA
  Tspan17_20
aatccttgaagacgaaggcc

SEQ ID NO: 63100 - DNA, 20 bp, Artificial Sequence
  sgRNA
  Tspan18_1
gagcttaccaagcactacca

SEQ ID NO: 63101 - DNA, 20 bp, Artificial Sequence
  sgRNA
  Tspan18_2
cgtcagcagccgaaacacgg

SEQ ID NO: 63102 - DNA, 20 bp, Artificial Sequence
  sgRNA
  Tspan18_3
gatcatgactgaattccagg

SEQ ID NO: 63103 - DNA, 20 bp, Artificial Sequence
  sgRNA
  Tspan18_4
tggctgctgagagctctacc

SEQ ID NO: 63104 - DNA, 20 bp, Artificial Sequence
  sgRNA
  Tspan18_5
acgatttctcggaagccggt

SEQ ID NO: 63105 - DNA, 20 bp, Artificial Sequence
  sgRNA
  Tspan18_6
gcccaaggcttgctgtcgga

SEQ ID NO: 63106 - DNA, 20 bp, Artificial Sequence
  sgRNA
  Tspan18_7
accaaccccctgctgaccac

SEQ ID NO: 63107 - DNA, 20 bp, Artificial Sequence
  sgRNA
  Tspan18_8
catccgtatcgttatcgcct

SEQ ID NO: 63108 - DNA, 20 bp, Artificial Sequence
  sgRNA
  Tspan18_9
gcctacatcgtactggccat

SEQ ID NO: 63109 - DNA, 20 bp, Artificial Sequence
  sgRNA
  Tspan18_10
tttgccatgtgcctcttccg

SEQ ID NO: 63110 - DNA, 20 bp, Artificial Sequence
  sgRNA
  Tspan18_11
gtagtgcttggtaagctcct

SEQ ID NO: 63111 - DNA, 20 bp, Artificial Sequence
  sgRNA
  Tspan18_12
gttatcgccttggtagtgct

SEQ ID NO: 63112 - DNA, 20 bp, Artificial Sequence
  sgRNA
  Tspan18_13
gatgccccggaagaggcaca

SEQ ID NO: 63113 - DNA, 20 bp, Artificial Sequence
  sgRNA
  Tspan18_14
cacgatttctcggaagccgg

SEQ ID NO: 63114 - DNA, 20 bp, Artificial Sequence
  sgRNA
  Tspan18_15
ggctccggccaggtagacat

SEQ ID NO: 63115 - DNA, 20 bp, Artificial Sequence
  sgRNA
  Tspan18_16
gctgacgctggacactgagg

SEQ ID NO: 63116 - DNA, 20 bp, Artificial Sequence
  sgRNA
  Tspan18_17
tacatcgtactggccatggg

SEQ ID NO: 63117 - DNA, 20 bp, Artificial Sequence
  sgRNA
  Tspan18_18
tgaacggattccgtcccagc

SEQ ID NO: 63118 - DNA, 20 bp, Artificial Sequence
  sgRNA
  Tspan18_19
ctaccaaggcgataacgata

SEQ ID NO: 63119 - DNA, 20 bp, Artificial Sequence
  sgRNA
  Tspan18_20
gtaggcaccggtggtcagca

SEQ ID NO: 63120 - DNA, 20 bp, Artificial Sequence
  sgRNA
  Tspan2_1
cacacactgtgactcacgca

SEQ ID NO: 63121 - DNA, 20 bp, Artificial Sequence
  sgRNA
  Tspan2_2
tgtacagagcatgtatgagg

SEQ ID NO: 63122 - DNA, 20 bp, Artificial Sequence
  sgRNA
  Tspan2_3
tcgatttggaggtaccatga

SEQ ID NO: 63123 - DNA, 20 bp, Artificial Sequence
  sgRNA
  Tspan2_4
taccttaaagacagggcaag

SEQ ID NO: 63124 - DNA, 20 bp, Artificial Sequence
  sgRNA
  Tspan2_5
gggagctcctttggacacgt

SEQ ID NO: 63125 - DNA, 20 bp, Artificial Sequence
  sgRNA
  Tspan2_6
aaagaagccatcatcttcgg

SEQ ID NO: 63126 - DNA, 20 bp, Artificial Sequence
  sgRNA
  Tspan2_7
tttgctgctgaagtaaccac

SEQ ID NO: 63127 - DNA, 20 bp, Artificial Sequence
  sgRNA
  Tspan2_8
tcatcttcggcggcatcgcc

SEQ ID NO: 63128 - DNA, 20 bp, Artificial Sequence
  sgRNA
  Tspan2_9
agtccagcccacgtgtccaa

SEQ ID NO: 63129 - DNA, 20 bp, Artificial Sequence
  sgRNA
  Tspan2_10
acgtgtccaaaggagctccc

SEQ ID NO: 63130 - DNA, 20 bp, Artificial Sequence
  sgRNA
  Tspan2_11
ggggccctgatgatgactgt

SEQ ID NO: 63131 - DNA, 20 bp, Artificial Sequence
  sgRNA
  Tspan2_12
acatgtacagagcatgtatg

SEQ ID NO: 63132 - DNA, 20 bp, Artificial Sequence
  sgRNA
  Tspan2_13
cagcgactaccttaaagaca

SEQ ID NO: 63133 - DNA, 20 bp, Artificial Sequence
  sgRNA
  Tspan2_14
tataaatgcaaatactccag

SEQ ID NO: 63134 - DNA, 20 bp, Artificial Sequence
  sgRNA
  Tspan2_15
agtgctaaactgcagctcat

SEQ ID NO: 63135 - DNA, 20 bp, Artificial Sequence
  sgRNA
  Tspan2_16
tgcatcaagtatctgctgct

SEQ ID NO: 63136 - DNA, 20 bp, Artificial Sequence
  sgRNA
  Tspan2_17
ctttggcatgatattcagca

SEQ ID NO: 63137 - DNA, 20 bp, Artificial Sequence
  sgRNA
  Tspan2_18
gcagatacttgatgcaccgc

SEQ ID NO: 63138 - DNA, 20 bp, Artificial Sequence
  sgRNA
  Tspan2_19
gctcctttggacacgtgggc

SEQ ID NO: 63139 - DNA, 20 bp, Artificial Sequence
  sgRNA
  Tspan2_20
acagcgactaccttaaagac

SEQ ID NO: 63140 - DNA, 20 bp, Artificial Sequence
  sgRNA
  Tspan3_1
tcctacagctatgatcacca

SEQ ID NO: 63141 - DNA, 20 bp, Artificial Sequence
  sgRNA
  Tspan3_2
aattcataactattcagact

SEQ ID NO: 63142 - DNA, 20 bp, Artificial Sequence
  sgRNA
  Tspan3_3
tctgcacatagtcaatagca

SEQ ID NO: 63143 - DNA, 20 bp, Artificial Sequence
  sgRNA
  Tspan3_4
ttaccgtggcaagtccacag

SEQ ID NO: 63144 - DNA, 20 bp, Artificial Sequence
  sgRNA
  Tspan3_5
cgactatgaccacttcttcg

SEQ ID NO: 63145 - DNA, 20 bp, Artificial Sequence
  sgRNA
  Tspan3_6
cataggctcccacgtagcag

SEQ ID NO: 63146 - DNA, 20 bp, Artificial Sequence
  sgRNA
  Tspan3_7
cagctatgatcaccacggca

SEQ ID NO: 63147 - DNA, 20 bp, Artificial Sequence
  sgRNA
  Tspan3_8
tatgagctcctcatcactgg

SEQ ID NO: 63148 - DNA, 20 bp, Artificial Sequence
  sgRNA
  Tspan3_9
ttaatgcttacagcatcggt

SEQ ID NO: 63149 - DNA, 20 bp, Artificial Sequence
  sgRNA
  Tspan3_10
ggacagccgctggctctgcg

SEQ ID NO: 63150 - DNA, 20 bp, Artificial Sequence
  sgRNA
  Tspan3_11
gtacacgctcttccctgccg

SEQ ID NO: 63151 - DNA, 20 bp, Artificial Sequence
  sgRNA
  Tspan3_12
ccacccttcacgaaacacca

SEQ ID NO: 63152 - DNA, 20 bp, Artificial Sequence
  sgRNA
  Tspan3_13
gaggactcagacaaagacag

SEQ ID NO: 63153 - DNA, 20 bp, Artificial Sequence
  sgRNA
  Tspan3_14
gcaccagcaacatcaacccc

SEQ ID NO: 63154 - DNA, 20 bp, Artificial Sequence
  sgRNA
  Tspan3_15
gccagtgatgaggagctcat

SEQ ID NO: 63155 - DNA, 20 bp, Artificial Sequence
  sgRNA
  Tspan3_16
gctggcatcctctgctacgt

SEQ ID NO: 63156 - DNA, 20 bp, Artificial Sequence
  sgRNA
  Tspan3_17
ccatggtgtttcgtgaaggg

SEQ ID NO: 63157 - DNA, 20 bp, Artificial Sequence
  sgRNA
  Tspan3_18
acagcggacccgactcacag

SEQ ID NO: 63158 - DNA, 20 bp, Artificial Sequence
  sgRNA
  Tspan3_19
gacagcggacccgactcaca

SEQ ID NO: 63159 - DNA, 20 bp, Artificial Sequence
  sgRNA
  Tspan3_20
cctcggcgtagaggtcagag

SEQ ID NO: 63160 - DNA, 20 bp, Artificial Sequence
  sgRNA
  Tspan31_1
tgcgctgtgcgctctcaacg

SEQ ID NO: 63161 - DNA, 20 bp, Artificial Sequence
  sgRNA
  Tspan31_2
ccagtcctgccaccgcgatg

SEQ ID NO: 63162 - DNA, 20 bp, Artificial Sequence
  sgRNA
  Tspan31_3
ggctattaacagaaacacac

SEQ ID NO: 63163 - DNA, 20 bp, Artificial Sequence
  sgRNA
  Tspan31_4
gaatgctagacaccacaccg

SEQ ID NO: 63164 - DNA, 20 bp, Artificial Sequence
  sgRNA
  Tspan31_5
cttccttctcctcatcgcgg

SEQ ID NO: 63165 - DNA, 20 bp, Artificial Sequence
  sgRNA
  Tspan31_6
tcattgctagccaaacacca

SEQ ID NO: 63166 - DNA, 20 bp, Artificial Sequence
  sgRNA
  Tspan31_7
cagatgtcatcaatgcttcg

SEQ ID NO: 63167 - DNA, 20 bp, Artificial Sequence
  sgRNA
  Tspan31_8
agtatcatcttgtaggcgca

SEQ ID NO: 63168 - DNA, 20 bp, Artificial Sequence
  sgRNA
  Tspan31_9
ggaagatgaagaccaaacct

SEQ ID NO: 63169 - DNA, 20 bp, Artificial Sequence
  sgRNA
  Tspan31_10
acttctctccagttcatgcc

SEQ ID NO: 63170 - DNA, 20 bp, Artificial Sequence
  sgRNA
  Tspan31_11
agtcttccttctcctcatcg

SEQ ID NO: 63171 - DNA, 20 bp, Artificial Sequence
  sgRNA
  Tspan31_12
gctctacatgccagatgtgt

SEQ ID NO: 63172 - DNA, 20 bp, Artificial Sequence
  sgRNA
  Tspan31_13
aacacctcctaggatcttga

SEQ ID NO: 63173 - DNA, 20 bp, Artificial Sequence
  sgRNA
  Tspan31_14
tgtcatcaatgcttcgtggt

SEQ ID NO: 63174 - DNA, 20 bp, Artificial Sequence
  sgRNA
  Tspan31_15
gacaaagccctcaagatcct

SEQ ID NO: 63175 - DNA, 20 bp, Artificial Sequence
  sgRNA
  Tspan31_16
agaagagcagcacttgatgg

SEQ ID NO: 63176 - DNA, 20 bp, Artificial Sequence
  sgRNA
  Tspan31_17
agatgatacttcctgtagtg

SEQ ID NO: 63177 - DNA, 20 bp, Artificial Sequence
  sgRNA
  Tspan31_18
cggtcttgagcaacagtacc

SEQ ID NO: 63178 - DNA, 20 bp, Artificial Sequence
  sgRNA
  Tspan31_19
catgccagatgtgtggggag

SEQ ID NO: 63179 - DNA, 20 bp, Artificial Sequence
  sgRNA
  Tspan31_20
tctagcattcacatcattgg

SEQ ID NO: 63180 - DNA, 20 bp, Artificial Sequence
  sgRNA
  Tspan33_1
gccaggctaatgaagcacgc

SEQ ID NO: 63181 - DNA, 20 bp, Artificial Sequence
  sgRNA
  Tspan33_2
gaatatgtacttcaactgct

SEQ ID NO: 63182 - DNA, 20 bp, Artificial Sequence
  sgRNA
  Tspan33_3
aaggcagatgttctcccgaa

SEQ ID NO: 63183 - DNA, 20 bp, Artificial Sequence
  sgRNA
  Tspan33_4
cgtgcattatcgagatgacc

SEQ ID NO: 63184 - DNA, 20 bp, Artificial Sequence
  sgRNA
  Tspan33_5
aacagcaccgagctgacccg

SEQ ID NO: 63185 - DNA, 20 bp, Artificial Sequence
  sgRNA
  Tspan33_6
gcggctgtatcggatccctt

SEQ ID NO: 63186 - DNA, 20 bp, Artificial Sequence
  sgRNA
  Tspan33_7
agagcaggtatttcaccagc

SEQ ID NO: 63187 - DNA, 20 bp, Artificial Sequence
  sgRNA
  Tspan33_8
gcagtgatcaacacgatgtg

SEQ ID NO: 63188 - DNA, 20 bp, Artificial Sequence
  sgRNA
  Tspan33_9
agtaaggtcatctacaccaa

SEQ ID NO: 63189 - DNA, 20 bp, Artificial Sequence
  sgRNA
  Tspan33_10
ggtaatctccatggtcatgg

SEQ ID NO: 63190 - DNA, 20 bp, Artificial Sequence
  sgRNA
  Tspan33_11
gctatcctgctgatcgtggt

SEQ ID NO: 63191 - DNA, 20 bp, Artificial Sequence
  sgRNA
  Tspan33_12
tatgtacttcaactgctcgg

SEQ ID NO: 63192 - DNA, 20 bp, Artificial Sequence
  sgRNA
  Tspan33_13
ggacgcccaccacgatcagc

SEQ ID NO: 63193 - DNA, 20 bp, Artificial Sequence
  sgRNA
  Tspan33_14
gttgggggtgggcaagcaac

SEQ ID NO: 63194 - DNA, 20 bp, Artificial Sequence
  sgRNA
  Tspan33_15
gcatgttgaagaagaagagc

SEQ ID NO: 63195 - DNA, 20 bp, Artificial Sequence
  sgRNA
  Tspan33_16
agcaacctgttcctgcttgg

SEQ ID NO: 63196 - DNA, 20 bp, Artificial Sequence
  sgRNA
  Tspan33_17
gtccaccgccagacaagcca

SEQ ID NO: 63197 - DNA, 20 bp, Artificial Sequence
  sgRNA
  Tspan33_18
tgtctgagaagacgaagccc

SEQ ID NO: 63198 - DNA, 20 bp, Artificial Sequence
  sgRNA
  Tspan33_19
tcttctggccaaagtcgatg

SEQ ID NO: 63199 - DNA, 20 bp, Artificial Sequence
  sgRNA
  Tspan33_20
cagctgcagcaggaacacga

SEQ ID NO: 63200 - DNA, 20 bp, Artificial Sequence
  sgRNA
  Tspan4_1
gtatggcacacagggcaacg

SEQ ID NO: 63201 - DNA, 20 bp, Artificial Sequence
  sgRNA
  Tspan4_2
ctgccgtggtcctagctggg

SEQ ID NO: 63202 - DNA, 20 bp, Artificial Sequence
  sgRNA
  Tspan4_3
ggtggcaaagtttccctgtg

SEQ ID NO: 63203 - DNA, 20 bp, Artificial Sequence
  sgRNA
  Tspan4_4
aattggaaactccacagcat

SEQ ID NO: 63204 - DNA, 20 bp, Artificial Sequence
  sgRNA
  Tspan4_5
gcagtacatggtcatagcga

SEQ ID NO: 63205 - DNA, 20 bp, Artificial Sequence
  sgRNA
  Tspan4_6
gcaggttgaaggcgaacatg

SEQ ID NO: 63206 - DNA, 20 bp, Artificial Sequence
  sgRNA
  Tspan4_7
gtactgccaggtggtaaagg

SEQ ID NO: 63207 - DNA, 20 bp, Artificial Sequence
  sgRNA
  Tspan4_8
gggaccttcgtcatggccat

SEQ ID NO: 63208 - DNA, 20 bp, Artificial Sequence
  sgRNA
  Tspan4_9
gcccaacaagacctgaagaa

SEQ ID NO: 63209 - DNA, 20 bp, Artificial Sequence
  sgRNA
  Tspan4_10
acatggtcatagcgaaggtg

SEQ ID NO: 63210 - DNA, 20 bp, Artificial Sequence
  sgRNA
  Tspan4_11
gctgctgctagtgttcctgc

SEQ ID NO: 63211 - DNA, 20 bp, Artificial Sequence
  sgRNA
  Tspan4_12
gcaggagtcaggcacacgag

SEQ ID NO: 63212 - DNA, 20 bp, Artificial Sequence
  sgRNA
  Tspan4_13
aatgcagcccacgaagccga

SEQ ID NO: 63213 - DNA, 20 bp, Artificial Sequence
  sgRNA
  Tspan4_14
gatggccatgacgaaggtcc

SEQ ID NO: 63214 - DNA, 20 bp, Artificial Sequence
  sgRNA
  Tspan4_15
tgaggtacttgacgccctgg

SEQ ID NO: 63215 - DNA, 20 bp, Artificial Sequence
  sgRNA
  Tspan4_16
tatggcacacagggcaacgt

SEQ ID NO: 63216 - DNA, 20 bp, Artificial Sequence
  sgRNA
  Tspan4_17
aggtgtccgcctttaccacc

SEQ ID NO: 63217 - DNA, 20 bp, Artificial Sequence
  sgRNA
  Tspan4_18
tatgaccatgtactgccagg

SEQ ID NO: 63218 - DNA, 20 bp, Artificial Sequence
  sgRNA
  Tspan4_19
gccttcactgtctcataaca

SEQ ID NO: 63219 - DNA, 20 bp, Artificial Sequence
  sgRNA
  Tspan4_20
ccaacctgctcatcgtcacc

SEQ ID NO: 63220 - DNA, 20 bp, Artificial Sequence
  sgRNA
  Tspan5_1
atctcgtccatcaccgacct

SEQ ID NO: 63221 - DNA, 20 bp, Artificial Sequence
  sgRNA
  Tspan5_2
gtttcttggaatcggactgt

SEQ ID NO: 63222 - DNA, 20 bp, Artificial Sequence
  sgRNA
  Tspan5_3
attcctgggtgaagtctatg

SEQ ID NO: 63223 - DNA, 20 bp, Artificial Sequence
  sgRNA
  Tspan5_4
ccaggaagaaaataatcccc

SEQ ID NO: 63224 - DNA, 20 bp, Artificial Sequence
  sgRNA
  Tspan5_5
gaacctcatagacttcaccc

SEQ ID NO: 63225 - DNA, 20 bp, Artificial Sequence
  sgRNA
  Tspan5_6
agttctttcttctccggcaa

SEQ ID NO: 63226 - DNA, 20 bp, Artificial Sequence
  sgRNA
  Tspan5_7
tgttcattctggggtttgca

SEQ ID NO: 63227 - DNA, 20 bp, Artificial Sequence
  sgRNA
  Tspan5_8
gcatcgctctcggcttgcat

SEQ ID NO: 63228 - DNA, 20 bp, Artificial Sequence
  sgRNA
  Tspan5_9
acatcactcctcccaccaca

SEQ ID NO: 63229 - DNA, 20 bp, Artificial Sequence
  sgRNA
  Tspan5_10
tcgtccatcaccgacctcgg

SEQ ID NO: 63230 - DNA, 20 bp, Artificial Sequence
  sgRNA
  Tspan5_11
ctgctgcactaaagaccccg

SEQ ID NO: 63231 - DNA, 20 bp, Artificial Sequence
  sgRNA
  Tspan5_12
acactgggtcaaagccaccg

SEQ ID NO: 63232 - DNA, 20 bp, Artificial Sequence
  sgRNA
  Tspan5_13
ggaataacgtttcttggaat

SEQ ID NO: 63233 - DNA, 20 bp, Artificial Sequence
  sgRNA
  Tspan5_14
tctttcttctccggcaaggg

SEQ ID NO: 63234 - DNA, 20 bp, Artificial Sequence
  sgRNA
  Tspan5_15
aatgcaagccgagagcgatg

SEQ ID NO: 63235 - DNA, 20 bp, Artificial Sequence
  sgRNA
  Tspan5_16
tgtagccacttctcaaactg

SEQ ID NO: 63236 - DNA, 20 bp, Artificial Sequence
  sgRNA
  Tspan5_17
cagattgtaatctacacaaa

SEQ ID NO: 63237 - DNA, 20 bp, Artificial Sequence
  sgRNA
  Tspan5_18
tatgaaaataccagccacga

SEQ ID NO: 63238 - DNA, 20 bp, Artificial Sequence
  sgRNA
  Tspan5_19
acaggacaatttaaccatcg

SEQ ID NO: 63239 - DNA, 20 bp, Artificial Sequence
  sgRNA
  Tspan5_20
gatatgcctggcacagaatt

SEQ ID NO: 63240 - DNA, 20 bp, Artificial Sequence
  sgRNA
  Tspan6_1
tctgaaaacaaatccaacaa

SEQ ID NO: 63241 - DNA, 20 bp, Artificial Sequence
  sgRNA
  Tspan6_2
aatgagcacaaaaggcacat

SEQ ID NO: 63242 - DNA, 20 bp, Artificial Sequence
  sgRNA
  Tspan6_3
cccaaatgccaacggcaaga

SEQ ID NO: 63243 - DNA, 20 bp, Artificial Sequence
  sgRNA
  Tspan6_4
ttcacttctatagtctcctg

SEQ ID NO: 63244 - DNA, 20 bp, Artificial Sequence
  sgRNA
  Tspan6_5
ctacctgtcgagcctccgcc

SEQ ID NO: 63245 - DNA, 20 bp, Artificial Sequence
  sgRNA
  Tspan6_6
aagagctgctgtaaactgga

SEQ ID NO: 63246 - DNA, 20 bp, Artificial Sequence
  sgRNA
  Tspan6_7
tattcgttatggcacgagac

SEQ ID NO: 63247 - DNA, 20 bp, Artificial Sequence
  sgRNA
  Tspan6_8
acaggtagcgaaacaaccaa

SEQ ID NO: 63248 - DNA, 20 bp, Artificial Sequence
  sgRNA
  Tspan6_9
ggtgttatccttcttgccgt

SEQ ID NO: 63249 - DNA, 20 bp, Artificial Sequence
  sgRNA
  Tspan6_10
ggtggccttctcatttaaga

SEQ ID NO: 63250 - DNA, 20 bp, Artificial Sequence
  sgRNA
  Tspan6_11
tgttgcggtgtcaccaatta

SEQ ID NO: 63251 - DNA, 20 bp, Artificial Sequence
  sgRNA
  Tspan6_12
tatggcacgagacaggcagt

SEQ ID NO: 63252 - DNA, 20 bp, Artificial Sequence
  sgRNA
  Tspan6_13
tgtagacaagatccaaagta

SEQ ID NO: 63253 - DNA, 20 bp, Artificial Sequence
  sgRNA
  Tspan6_14
tccagtttacagcagctctt

SEQ ID NO: 63254 - DNA, 20 bp, Artificial Sequence
  sgRNA
  Tspan6_15
caagagctgctgtaaactgg

SEQ ID NO: 63255 - DNA, 20 bp, Artificial Sequence
  sgRNA
  Tspan6_16
caccttgccccaaatgccaa

SEQ ID NO: 63256 - DNA, 20 bp, Artificial Sequence
  sgRNA
  Tspan6_17
agtctgcagcctccgagatg

SEQ ID NO: 63257 - DNA, 20 bp, Artificial Sequence
  sgRNA
  Tspan6_18
catccaggcggaggctcgac

SEQ ID NO: 63258 - DNA, 20 bp, Artificial Sequence
  sgRNA
  Tspan6_19
ggcactgtcattattctctt

SEQ ID NO: 63259 - DNA, 20 bp, Artificial Sequence
  sgRNA
  Tspan6_20
gagcacaaaaggcacattgg

SEQ ID NO: 63260 - DNA, 20 bp, Artificial Sequence
  sgRNA
  Tspan7_1
tcagcatccatggactacca

SEQ ID NO: 63261 - DNA, 20 bp, Artificial Sequence
  sgRNA
  Tspan7_2
tggaaccggcaccaccatcg

SEQ ID NO: 63262 - DNA, 20 bp, Artificial Sequence
  sgRNA
  Tspan7_3
atccgtgtaagtcctcagga

SEQ ID NO: 63263 - DNA, 20 bp, Artificial Sequence
  sgRNA
  Tspan7_4
tctcctttcgcagatcactg

SEQ ID NO: 63264 - DNA, 20 bp, Artificial Sequence
  sgRNA
  Tspan7_5
ggatctgcacaatctgactg

SEQ ID NO: 63265 - DNA, 20 bp, Artificial Sequence
  sgRNA
  Tspan7_6
aaagaggccaaaaaccacga

SEQ ID NO: 63266 - DNA, 20 bp, Artificial Sequence
  sgRNA
  Tspan7_7
actacaatggcaatgatgag

SEQ ID NO: 63267 - DNA, 20 bp, Artificial Sequence
  sgRNA
  Tspan7_8
ctacatgccgtggtagtcca

SEQ ID NO: 63268 - DNA, 20 bp, Artificial Sequence
  sgRNA
  Tspan7_9
cgttcatgcagcaactgggg

SEQ ID NO: 63269 - DNA, 20 bp, Artificial Sequence
  sgRNA
  Tspan7_10
attgccattgtagttctgca

SEQ ID NO: 63270 - DNA, 20 bp, Artificial Sequence
  sgRNA
  Tspan7_11
gtcagattgtgcagatccag

SEQ ID NO: 63271 - DNA, 20 bp, Artificial Sequence
  sgRNA
  Tspan7_12
gcgtgcagaactacaccaac

SEQ ID NO: 63272 - DNA, 20 bp, Artificial Sequence
  sgRNA
  Tspan7_13
tcgttcatgcagcaactggg

SEQ ID NO: 63273 - DNA, 20 bp, Artificial Sequence
  sgRNA
  Tspan7_14
gatgccatgcagaactacaa

SEQ ID NO: 63274 - DNA, 20 bp, Artificial Sequence
  sgRNA
  Tspan7_15
gctgcacatggtccacagcc

SEQ ID NO: 63275 - DNA, 20 bp, Artificial Sequence
  sgRNA
  Tspan7_16
caccttcctgaggacttaca

SEQ ID NO: 63276 - DNA, 20 bp, Artificial Sequence
  sgRNA
  Tspan7_17
aagctcagccaggaacacca

SEQ ID NO: 63277 - DNA, 20 bp, Artificial Sequence
  sgRNA
  Tspan7_18
gtatgccatgttcctgtccc

SEQ ID NO: 63278 - DNA, 20 bp, Artificial Sequence
  sgRNA
  Tspan7_19
cccagactccaacggccaac

SEQ ID NO: 63279 - DNA, 20 bp, Artificial Sequence
  sgRNA
  Tspan7_20
cgaaactgactgcaatcccc

SEQ ID NO: 63280 - DNA, 20 bp, Artificial Sequence
  sgRNA
  Tspan8_1
tgaggcaaaagacttccaga

SEQ ID NO: 63281 - DNA, 20 bp, Artificial Sequence
  sgRNA
  Tspan8_2
gtatgtggtacactgatctt

SEQ ID NO: 63282 - DNA, 20 bp, Artificial Sequence
  sgRNA
  Tspan8_3
acgtacctcaggtttgaaag

SEQ ID NO: 63283 - DNA, 20 bp, Artificial Sequence
  sgRNA
  Tspan8_4
agatattcacagcaatgaag

SEQ ID NO: 63284 - DNA, 20 bp, Artificial Sequence
  sgRNA
  Tspan8_5
gctgattctgattctgcaag

SEQ ID NO: 63285 - DNA, 20 bp, Artificial Sequence
  sgRNA
  Tspan8_6
gtggagctgtgaaagaaagc

SEQ ID NO: 63286 - DNA, 20 bp, Artificial Sequence
  sgRNA
  Tspan8_7
tggagaatggagctgccgac

SEQ ID NO: 63287 - DNA, 20 bp, Artificial Sequence
  sgRNA
  Tspan8_8
ctgactgtgcaacttatcag

SEQ ID NO: 63288 - DNA, 20 bp, Artificial Sequence
  sgRNA
  Tspan8_9
tctgtcggacaacactgatg

SEQ ID NO: 63289 - DNA, 20 bp, Artificial Sequence
  sgRNA
  Tspan8_10
tggtacactgatcttgggac

SEQ ID NO: 63290 - DNA, 20 bp, Artificial Sequence
  sgRNA
  Tspan8_11
aagatattcacagcaatgaa

SEQ ID NO: 63291 - DNA, 20 bp, Artificial Sequence
  sgRNA
  Tspan8_12
ggccatgattgtgtttcagt

SEQ ID NO: 63292 - DNA, 20 bp, Artificial Sequence
  sgRNA
  Tspan8_13
tcacagctccacagcatccc

SEQ ID NO: 63293 - DNA, 20 bp, Artificial Sequence
  sgRNA
  Tspan8_14
tgaaaatgctaagcttctgt

SEQ ID NO: 63294 - DNA, 20 bp, Artificial Sequence
  sgRNA
  Tspan8_15
actgactgtgcaacttatca

SEQ ID NO: 63295 - DNA, 20 bp, Artificial Sequence
  sgRNA
  Tspan8_16
atggtgctatactgccagat

SEQ ID NO: 63296 - DNA, 20 bp, Artificial Sequence
  sgRNA
  Tspan8_17
cacaaaattatttccccagt

SEQ ID NO: 63297 - DNA, 20 bp, Artificial Sequence
  sgRNA
  Tspan8_18
tttgcttactctcacccata

SEQ ID NO: 63298 - DNA, 20 bp, Artificial Sequence
  sgRNA
  Tspan8_19
atagcgtttcattcagaatt

SEQ ID NO: 63299 - DNA, 20 bp, Artificial Sequence
  sgRNA
  Tspan8_20
ctaggtttcctgggatgctg

SEQ ID NO: 63300 - DNA, 20 bp, Artificial Sequence
  sgRNA
  Tspan9_1
acaacacagagaacaacgtg

SEQ ID NO: 63301 - DNA, 20 bp, Artificial Sequence
  sgRNA
  Tspan9_2
gaagcccgtcaccatgacga

SEQ ID NO: 63302 - DNA, 20 bp, Artificial Sequence
  sgRNA
  Tspan9_3
cccacagatgcggtgttgtg

SEQ ID NO: 63303 - DNA, 20 bp, Artificial Sequence
  sgRNA
  Tspan9_4
cttcttcgtctacatggaca

SEQ ID NO: 63304 - DNA, 20 bp, Artificial Sequence
  sgRNA
  Tspan9_5
ggttggctgcggacagtgag

SEQ ID NO: 63305 - DNA, 20 bp, Artificial Sequence
  sgRNA
  Tspan9_6
tcagaatcaactctgccagc

SEQ ID NO: 63306 - DNA, 20 bp, Artificial Sequence
  sgRNA
  Tspan9_7
actgtgttctccccgagcac

SEQ ID NO: 63307 - DNA, 20 bp, Artificial Sequence
  sgRNA
  Tspan9_8
gcaacagcaccacccccttg

SEQ ID NO: 63308 - DNA, 20 bp, Artificial Sequence
  sgRNA
  Tspan9_9
tgctgcatggagaattccca

SEQ ID NO: 63309 - DNA, 20 bp, Artificial Sequence
  sgRNA
  Tspan9_10
gccaacctcgtcatcgccat

SEQ ID NO: 63310 - DNA, 20 bp, Artificial Sequence
  sgRNA
  Tspan9_11
acgtggggctcaagaacgcc

SEQ ID NO: 63311 - DNA, 20 bp, Artificial Sequence
  sgRNA
  Tspan9_12
gccgatggcgatgacgaggt

SEQ ID NO: 63312 - DNA, 20 bp, Artificial Sequence
  sgRNA
  Tspan9_13
gatgaggatgcacatgccca

SEQ ID NO: 63313 - DNA, 20 bp, Artificial Sequence
  sgRNA
  Tspan9_14
tacaacacagagaacaacgt

SEQ ID NO: 63314 - DNA, 20 bp, Artificial Sequence
  sgRNA
  Tspan9_15
tgtccatgtagacgaagaag

SEQ ID NO: 63315 - DNA, 20 bp, Artificial Sequence
  sgRNA
  Tspan9_16
ctacaacacagagaacaacg

SEQ ID NO: 63316 - DNA, 20 bp, Artificial Sequence
  sgRNA
  Tspan9_17
tgttctccttgatggccccc

SEQ ID NO: 63317 - DNA, 20 bp, Artificial Sequence
  sgRNA
  Tspan9_18
gccaagcaggacctgaaaga

SEQ ID NO: 63318 - DNA, 20 bp, Artificial Sequence
  sgRNA
  Tspan9_19
agactggtatccggtgctcg

SEQ ID NO: 63319 - DNA, 20 bp, Artificial Sequence
  sgRNA
  Tspan9_20
gaacgcctggaacatcatcc

SEQ ID NO: 63320 - DNA, 20 bp, Artificial Sequence
  sgRNA
  Ttyh1_1
ggaagtgctgtcagtccgca

SEQ ID NO: 63321 - DNA, 20 bp, Artificial Sequence
  sgRNA
  Ttyh1_2
gactatggctcagcactccg

SEQ ID NO: 63322 - DNA, 20 bp, Artificial Sequence
  sgRNA
  Ttyh1_3
tcgcggggagcaaagccgct

SEQ ID NO: 63323 - DNA, 20 bp, Artificial Sequence
  sgRNA
  Ttyh1_4
catcttcagccacctgtacg

SEQ ID NO: 63324 - DNA, 20 bp, Artificial Sequence
  sgRNA
  Ttyh1_5
ctatgtgctgaacctgaccc

SEQ ID NO: 63325 - DNA, 20 bp, Artificial Sequence
  sgRNA
  Ttyh1_6
tggcagccaccagctccatg

SEQ ID NO: 63326 - DNA, 20 bp, Artificial Sequence
  sgRNA
  Ttyh1_7
ctgccaccaggggagcccga

SEQ ID NO: 63327 - DNA, 20 bp, Artificial Sequence
  sgRNA
  Ttyh1_8
gatggtgctgagcgtgtggt

SEQ ID NO: 63328 - DNA, 20 bp, Artificial Sequence
  sgRNA
  Ttyh1_9
ggcaaagcagagcaaatggc

SEQ ID NO: 63329 - DNA, 20 bp, Artificial Sequence
  sgRNA
  Ttyh1_10
aatccaaacgctttgtgcag

SEQ ID NO: 63330 - DNA, 20 bp, Artificial Sequence
  sgRNA
  Ttyh1_11
gatgcacccaggcagagggt

SEQ ID NO: 63331 - DNA, 20 bp, Artificial Sequence
  sgRNA
  Ttyh1_12
gctgggtgaggcagtgaaga

SEQ ID NO: 63332 - DNA, 20 bp, Artificial Sequence
  sgRNA
  Ttyh1_13
gctcagcaccatcgatgacg

SEQ ID NO: 63333 - DNA, 20 bp, Artificial Sequence
  sgRNA
  Ttyh1_14
gccaagagtcccccacccgg

SEQ ID NO: 63334 - DNA, 20 bp, Artificial Sequence
  sgRNA
  Ttyh1_15
gcctaaaccaagcccagcca

SEQ ID NO: 63335 - DNA, 20 bp, Artificial Sequence
  sgRNA
  Ttyh1_16
gcactgccgcagtctgcaca

SEQ ID NO: 63336 - DNA, 20 bp, Artificial Sequence
  sgRNA
  Ttyh1_17
ccgcgaccaagagtaccagc

SEQ ID NO: 63337 - DNA, 20 bp, Artificial Sequence
  sgRNA
  Ttyh1_18
ttatttcctgtgcaaccagg

SEQ ID NO: 63338 - DNA, 20 bp, Artificial Sequence
  sgRNA
  Ttyh1_19
gtctcctccaaggataacaa

SEQ ID NO: 63339 - DNA, 20 bp, Artificial Sequence
  sgRNA
  Ttyh1_20
tctgctttgccaggcccagg

SEQ ID NO: 63340 - DNA, 20 bp, Artificial Sequence
  sgRNA
  Ttyh2_1
gaaacagcgagaccaacgat

SEQ ID NO: 63341 - DNA, 20 bp, Artificial Sequence
  sgRNA
  Ttyh2_2
cctggtaagtttcgtcgccg

SEQ ID NO: 63342 - DNA, 20 bp, Artificial Sequence
  sgRNA
  Ttyh2_3
acagggagccagatcaactc

SEQ ID NO: 63343 - DNA, 20 bp, Artificial Sequence
  sgRNA
  Ttyh2_4
tcacctgtagtattccacat

SEQ ID NO: 63344 - DNA, 20 bp, Artificial Sequence
  sgRNA
  Ttyh2_5
ccgccatgttggattgccga

SEQ ID NO: 63345 - DNA, 20 bp, Artificial Sequence
  sgRNA
  Ttyh2_6
cggcccataaccccacgagg

SEQ ID NO: 63346 - DNA, 20 bp, Artificial Sequence
  sgRNA
  Ttyh2_7
tcgcggcccataaccccacg

SEQ ID NO: 63347 - DNA, 20 bp, Artificial Sequence
  sgRNA
  Ttyh2_8
actgcaatggaggtagtacc

SEQ ID NO: 63348 - DNA, 20 bp, Artificial Sequence
  sgRNA
  Ttyh2_9
tctgcaccgtgtggtcccgc

SEQ ID NO: 63349 - DNA, 20 bp, Artificial Sequence
  sgRNA
  Ttyh2_10
tccgccacggacatgtaggt

SEQ ID NO: 63350 - DNA, 20 bp, Artificial Sequence
  sgRNA
  Ttyh2_11
gagacccacctacatgtccg

SEQ ID NO: 63351 - DNA, 20 bp, Artificial Sequence
  sgRNA
  Ttyh2_12
ggaaacagcgagaccaacga

SEQ ID NO: 63352 - DNA, 20 bp, Artificial Sequence
  sgRNA
  Ttyh2_13
atgctgcgtgacctggacgg

SEQ ID NO: 63353 - DNA, 20 bp, Artificial Sequence
  sgRNA
  Ttyh2_14
agcgagatcattgctgcccg

SEQ ID NO: 63354 - DNA, 20 bp, Artificial Sequence
  sgRNA
  Ttyh2_15
gcatgtgcacaccaggtaga

SEQ ID NO: 63355 - DNA, 20 bp, Artificial Sequence
  sgRNA
  Ttyh2_16
tcagcgagatcattgctgcc

SEQ ID NO: 63356 - DNA, 20 bp, Artificial Sequence
  sgRNA
  Ttyh2_17
accgccatgttggattgccg

SEQ ID NO: 63357 - DNA, 20 bp, Artificial Sequence
  sgRNA
  Ttyh2_18
gtagacagcaccttcagccc

SEQ ID NO: 63358 - DNA, 20 bp, Artificial Sequence
  sgRNA
  Ttyh2_19
tctacatcctgaacaacaca

SEQ ID NO: 63359 - DNA, 20 bp, Artificial Sequence
  sgRNA
  Ttyh2_20
aatgtgccactcatcgggag

SEQ ID NO: 63360 - DNA, 20 bp, Artificial Sequence
  sgRNA
  Ttyh3_1
ggaaatgcaagatgttgtcg

SEQ ID NO: 63361 - DNA, 20 bp, Artificial Sequence
  sgRNA
  Ttyh3_2
gagcactcagtactgagtgg

SEQ ID NO: 63362 - DNA, 20 bp, Artificial Sequence
  sgRNA
  Ttyh3_3
gaaccccggagtatcgctgg

SEQ ID NO: 63363 - DNA, 20 bp, Artificial Sequence
  sgRNA
  Ttyh3_4
acgccatgccaaccgcacag

SEQ ID NO: 63364 - DNA, 20 bp, Artificial Sequence
  sgRNA
  Ttyh3_5
gcacctccagcgatactccg

SEQ ID NO: 63365 - DNA, 20 bp, Artificial Sequence
  sgRNA
  Ttyh3_6
ggactcgcgcccaatgaggg

SEQ ID NO: 63366 - DNA, 20 bp, Artificial Sequence
  sgRNA
  Ttyh3_7
gctgctgaggaacgtccccc

SEQ ID NO: 63367 - DNA, 20 bp, Artificial Sequence
  sgRNA
  Ttyh3_8
atgcccagtttgtacagctg

SEQ ID NO: 63368 - DNA, 20 bp, Artificial Sequence
  sgRNA
  Ttyh3_9
cgaggacgccgactaccagc

SEQ ID NO: 63369 - DNA, 20 bp, Artificial Sequence
  sgRNA
  Ttyh3_10
tgccgccctgaaccgcacag

SEQ ID NO: 63370 - DNA, 20 bp, Artificial Sequence
  sgRNA
  Ttyh3_11
aagagactgcgccagggccg

SEQ ID NO: 63371 - DNA, 20 bp, Artificial Sequence
  sgRNA
  Ttyh3_12
tctgcagcatcccacacacc

SEQ ID NO: 63372 - DNA, 20 bp, Artificial Sequence
  sgRNA
  Ttyh3_13
tcccaccgcaggtcgaagtg

SEQ ID NO: 63373 - DNA, 20 bp, Artificial Sequence
  sgRNA
  Ttyh3_14
aggggggtgttctcacagcg

SEQ ID NO: 63374 - DNA, 20 bp, Artificial Sequence
  sgRNA
  Ttyh3_15
tagcacctccagcgatactc

SEQ ID NO: 63375 - DNA, 20 bp, Artificial Sequence
  sgRNA
  Ttyh3_16
tgaggcccaccagcaccagg

SEQ ID NO: 63376 - DNA, 20 bp, Artificial Sequence
  sgRNA
  Ttyh3_17
ggctgccgcacttcgacctg

SEQ ID NO: 63377 - DNA, 20 bp, Artificial Sequence
  sgRNA
  Ttyh3_18
gcagtgggattctacggcaa

SEQ ID NO: 63378 - DNA, 20 bp, Artificial Sequence
  sgRNA
  Ttyh3_19
cctggacccctgccactgtg

SEQ ID NO: 63379 - DNA, 20 bp, Artificial Sequence
  sgRNA
  Ttyh3_20
ggggttcctccaaaagggga

SEQ ID NO: 63380 - DNA, 20 bp, Artificial Sequence
  sgRNA
  Txndc15_1
accaccatgggatctccgcg

SEQ ID NO: 63381 - DNA, 20 bp, Artificial Sequence
  sgRNA
  Txndc15_2
ccaagtgttggaaacgcccg

SEQ ID NO: 63382 - DNA, 20 bp, Artificial Sequence
  sgRNA
  Txndc15_3
ttgggtttaggaaatccatg

SEQ ID NO: 63383 - DNA, 20 bp, Artificial Sequence
  sgRNA
  Txndc15_4
tgtgtatctgcatgaagagg

SEQ ID NO: 63384 - DNA, 20 bp, Artificial Sequence
  sgRNA
  Txndc15_5
tcgggaccaggcaagagcgg

SEQ ID NO: 63385 - DNA, 20 bp, Artificial Sequence
  sgRNA
  Txndc15_6
tggtcctcttctacaccccg

SEQ ID NO: 63386 - DNA, 20 bp, Artificial Sequence
  sgRNA
  Txndc15_7
gccaccgaatactctcagtg

SEQ ID NO: 63387 - DNA, 20 bp, Artificial Sequence
  sgRNA
  Txndc15_8
gatggcacctgcagtgcgca

SEQ ID NO: 63388 - DNA, 20 bp, Artificial Sequence
  sgRNA
  Txndc15_9
gcaggacttgccaccagcag

SEQ ID NO: 63389 - DNA, 20 bp, Artificial Sequence
  sgRNA
  Txndc15_10
ggagaggaggacccgagctg

SEQ ID NO: 63390 - DNA, 20 bp, Artificial Sequence
  sgRNA
  Txndc15_11
atggatttcctaaacccaaa

SEQ ID NO: 63391 - DNA, 20 bp, Artificial Sequence
  sgRNA
  Txndc15_12
tgtggccgagagaacctctt

SEQ ID NO: 63392 - DNA, 20 bp, Artificial Sequence
  sgRNA
  Txndc15_13
tccgcactgagagtattcgg

SEQ ID NO: 63393 - DNA, 20 bp, Artificial Sequence
  sgRNA
  Txndc15_14
ggcagaaaaccggcaccacg

SEQ ID NO: 63394 - DNA, 20 bp, Artificial Sequence
  sgRNA
  Txndc15_15
gtatggttaaaccttgccat

SEQ ID NO: 63395 - DNA, 20 bp, Artificial Sequence
  sgRNA
  Txndc15_16
ccaaggtgaattgtgaggag

SEQ ID NO: 63396 - DNA, 20 bp, Artificial Sequence
  sgRNA
  Txndc15_17
ccgaatactctcagtgcgga

SEQ ID NO: 63397 - DNA, 20 bp, Artificial Sequence
  sgRNA
  Txndc15_18
gggtccgcgcggagatccca

SEQ ID NO: 63398 - DNA, 20 bp, Artificial Sequence
  sgRNA
  Txndc15_19
ccgctcttgcctggtcccga

SEQ ID NO: 63399 - DNA, 20 bp, Artificial Sequence
  sgRNA
  Txndc15_20
ggaggttgctcaggaccatc

SEQ ID NO: 63400 - DNA, 20 bp, Artificial Sequence
  sgRNA
  Tyr_1
agaaattcgagaactaactg

SEQ ID NO: 63401 - DNA, 20 bp, Artificial Sequence
  sgRNA
  Tyr_2
tttatgcgatggaacacctg

SEQ ID NO: 63402 - DNA, 20 bp, Artificial Sequence
  sgRNA
  Tyr_3
atgttgatatcattaaacat

SEQ ID NO: 63403 - DNA, 20 bp, Artificial Sequence
  sgRNA
  Tyr_4
acccctttgaaggggaactg

SEQ ID NO: 63404 - DNA, 20 bp, Artificial Sequence
  sgRNA
  Tyr_5
agtaatgcatccatacaaag

SEQ ID NO: 63405 - DNA, 20 bp, Artificial Sequence
  sgRNA
  Tyr_6
gtagtcatatcccagatcct

SEQ ID NO: 63406 - DNA, 20 bp, Artificial Sequence
  sgRNA
  Tyr_7
ggtcctattataaaacacag

SEQ ID NO: 63407 - DNA, 20 bp, Artificial Sequence
  sgRNA
  Tyr_8
gttggccgatccctgtactt

SEQ ID NO: 63408 - DNA, 20 bp, Artificial Sequence
  sgRNA
  Tyr_9
tcagttccccttcaaagggg

SEQ ID NO: 63409 - DNA, 20 bp, Artificial Sequence
  sgRNA
  Tyr_10
ccagaagccaatgcacctat

SEQ ID NO: 63410 - DNA, 20 bp, Artificial Sequence
  sgRNA
  Tyr_11
gagtctctgttatggccgat

SEQ ID NO: 63411 - DNA, 20 bp, Artificial Sequence
  sgRNA
  Tyr_12
atgacaaagccaaaaccccc

SEQ ID NO: 63412 - DNA, 20 bp, Artificial Sequence
  sgRNA
  Tyr_13
ttatgcgatggaacacctga

SEQ ID NO: 63413 - DNA, 20 bp, Artificial Sequence
  sgRNA
  Tyr_14
ggtagtcgtctttgtccatg

SEQ ID NO: 63414 - DNA, 20 bp, Artificial Sequence
  sgRNA
  Tyr_15
tgcacagatgagtacttggg

SEQ ID NO: 63415 - DNA, 20 bp, Artificial Sequence
  sgRNA
  Tyr_16
atttggccataggtgcctgt

SEQ ID NO: 63416 - DNA, 20 bp, Artificial Sequence
  sgRNA
  Tyr_17
gacctcagttccccttcaaa

SEQ ID NO: 63417 - DNA, 20 bp, Artificial Sequence
  sgRNA
  Tyr_18
ctgcctgaaagctggccgca

SEQ ID NO: 63418 - DNA, 20 bp, Artificial Sequence
  sgRNA
  Tyr_19
aagccagtcgtatctggcca

SEQ ID NO: 63419 - DNA, 20 bp, Artificial Sequence
  sgRNA
  Tyr_20
tcgtctttgtccatgaggag

SEQ ID NO: 63420 - DNA, 20 bp, Artificial Sequence
  sgRNA
  Tyro3_1
ggagtttgaccatccacacg

SEQ ID NO: 63421 - DNA, 20 bp, Artificial Sequence
  sgRNA
  Tyro3_2
taggagagtttggatcagtg

SEQ ID NO: 63422 - DNA, 20 bp, Artificial Sequence
  sgRNA
  Tyro3_3
acagcttataaggtcctagg

SEQ ID NO: 63423 - DNA, 20 bp, Artificial Sequence
  sgRNA
  Tyro3_4
aacccgtaaccatttactgg

SEQ ID NO: 63424 - DNA, 20 bp, Artificial Sequence
  sgRNA
  Tyro3_5
ggtacatcttcagccccgga

SEQ ID NO: 63425 - DNA, 20 bp, Artificial Sequence
  sgRNA
  Tyro3_6
ctttgcccaacatccgaccg

SEQ ID NO: 63426 - DNA, 20 bp, Artificial Sequence
  sgRNA
  Tyro3_7
ctctcggaaaatctatagcg

SEQ ID NO: 63427 - DNA, 20 bp, Artificial Sequence
  sgRNA
  Tyro3_8
tgacagtgtcatggcccgag

SEQ ID NO: 63428 - DNA, 20 bp, Artificial Sequence
  sgRNA
  Tyro3_9
agatgtaccgagagtcactg

SEQ ID NO: 63429 - DNA, 20 bp, Artificial Sequence
  sgRNA
  Tyro3_10
agtggaaccaaaagatctgg

SEQ ID NO: 63430 - DNA, 20 bp, Artificial Sequence
  sgRNA
  Tyro3_11
tggagagcgatccagcagcg

SEQ ID NO: 63431 - DNA, 20 bp, Artificial Sequence
  sgRNA
  Tyro3_12
tcatgcaagctgcttcccgg

SEQ ID NO: 63432 - DNA, 20 bp, Artificial Sequence
  sgRNA
  Tyro3_13
cctgcttcggaagagacgca

SEQ ID NO: 63433 - DNA, 20 bp, Artificial Sequence
  sgRNA
  Tyro3_14
gagggctatccgagtcacca

SEQ ID NO: 63434 - DNA, 20 bp, Artificial Sequence
  sgRNA
  Tyro3_15
tgtgggagatcatgactcgt

SEQ ID NO: 63435 - DNA, 20 bp, Artificial Sequence
  sgRNA
  Tyro3_16
tcatgagaagacaccaccag

SEQ ID NO: 63436 - DNA, 20 bp, Artificial Sequence
  sgRNA
  Tyro3_17
tttacaactacctcatcggc

SEQ ID NO: 63437 - DNA, 20 bp, Artificial Sequence
  sgRNA
  Tyro3_18
tctgctcgcctcccgaatcg

SEQ ID NO: 63438 - DNA, 20 bp, Artificial Sequence
  sgRNA
  Tyro3_19
ctacaacgctagcgtggcct

SEQ ID NO: 63439 - DNA, 20 bp, Artificial Sequence
  sgRNA
  Tyro3_20
acgagtcatgatctcccaca

SEQ ID NO: 63440 - DNA, 20 bp, Artificial Sequence
  sgRNA
  Tyrp1_1
cttgtggcaatgacaaattg

SEQ ID NO: 63441 - DNA, 20 bp, Artificial Sequence
  sgRNA
  Tyrp1_2
cctgtgccatgtgagaaaag

SEQ ID NO: 63442 - DNA, 20 bp, Artificial Sequence
  sgRNA
  Tyrp1_3
gttctattaaagaacctcag

SEQ ID NO: 63443 - DNA, 20 bp, Artificial Sequence
  sgRNA
  Tyrp1_4
ttggaagagtacgataccct

SEQ ID NO: 63444 - DNA, 20 bp, Artificial Sequence
  sgRNA
  Tyrp1_5
cggtcatctttaccatcgtg

SEQ ID NO: 63445 - DNA, 20 bp, Artificial Sequence
  sgRNA
  Tyrp1_6
tgtggctcatcatcaggaag

SEQ ID NO: 63446 - DNA, 20 bp, Artificial Sequence
  sgRNA
  Tyrp1_7
gatgtggatttctctcacga

SEQ ID NO: 63447 - DNA, 20 bp, Artificial Sequence
  sgRNA
  Tyrp1_8
gaagacatactgggaccaga

SEQ ID NO: 63448 - DNA, 20 bp, Artificial Sequence
  sgRNA
  Tyrp1_9
gcagctggagagagacatgc

SEQ ID NO: 63449 - DNA, 20 bp, Artificial Sequence
  sgRNA
  Tyrp1_10
ggtctccctacatttccagc

SEQ ID NO: 63450 - DNA, 20 bp, Artificial Sequence
  sgRNA
  Tyrp1_11
gtctccctacatttccagct

SEQ ID NO: 63451 - DNA, 20 bp, Artificial Sequence
  sgRNA
  Tyrp1_12
tattgaggctctgagacgtg

SEQ ID NO: 63452 - DNA, 20 bp, Artificial Sequence
  sgRNA
  Tyrp1_13
aagcactgagtgacatcctg

SEQ ID NO: 63453 - DNA, 20 bp, Artificial Sequence
  sgRNA
  Tyrp1_14
gcggctatcagaccatggag

SEQ ID NO: 63454 - DNA, 20 bp, Artificial Sequence
  sgRNA
  Tyrp1_15
ttcctgatgatgagccacaa

SEQ ID NO: 63455 - DNA, 20 bp, Artificial Sequence
  sgRNA
  Tyrp1_16
tgtgaaggcttcgaacagca

SEQ ID NO: 63456 - DNA, 20 bp, Artificial Sequence
  sgRNA
  Tyrp1_17
cagtccccggtccagaggaa

SEQ ID NO: 63457 - DNA, 20 bp, Artificial Sequence
  sgRNA
  Tyrp1_18
tattgcctgttatgtccaat

SEQ ID NO: 63458 - DNA, 20 bp, Artificial Sequence
  sgRNA
  Tyrp1_19
gacaggacaggaaagctttg

SEQ ID NO: 63459 - DNA, 20 bp, Artificial Sequence
  sgRNA
  Tyrp1_20
acgctatgctgaggactatg

SEQ ID NO: 63460 - DNA, 20 bp, Artificial Sequence
  sgRNA
  Ubac2_1
gacaccaagcgaatactgca

SEQ ID NO: 63461 - DNA, 20 bp, Artificial Sequence
  sgRNA
  Ubac2_2
agaactcggccattctgcca

SEQ ID NO: 63462 - DNA, 20 bp, Artificial Sequence
  sgRNA
  Ubac2_3
agaaagcgtctttcaagtca

SEQ ID NO: 63463 - DNA, 20 bp, Artificial Sequence
  sgRNA
  Ubac2_4
ggaacaaagagagcgaacac

SEQ ID NO: 63464 - DNA, 20 bp, Artificial Sequence
  sgRNA
  Ubac2_5
ttcgtcgctgacgtaaaggg

SEQ ID NO: 63465 - DNA, 20 bp, Artificial Sequence
  sgRNA
  Ubac2_6
gatgctcgctgctcagaccg

SEQ ID NO: 63466 - DNA, 20 bp, Artificial Sequence
  sgRNA
  Ubac2_7
gtattcgcttggtgtcacag

SEQ ID NO: 63467 - DNA, 20 bp, Artificial Sequence
  sgRNA
  Ubac2_8
tggacatccagagacagcag

SEQ ID NO: 63468 - DNA, 20 bp, Artificial Sequence
  sgRNA
  Ubac2_9
aatccagatgtaggacccag

SEQ ID NO: 63469 - DNA, 20 bp, Artificial Sequence
  sgRNA
  Ubac2_10
ctgtctctggatgtccacgg

SEQ ID NO: 63470 - DNA, 20 bp, Artificial Sequence
  sgRNA
  Ubac2_11
agaacccaccagcgaggcca

SEQ ID NO: 63471 - DNA, 20 bp, Artificial Sequence
  sgRNA
  Ubac2_12
tcaactatcaagatggacct

SEQ ID NO: 63472 - DNA, 20 bp, Artificial Sequence
  sgRNA
  Ubac2_13
tttcgtcgctgacgtaaagg

SEQ ID NO: 63473 - DNA, 20 bp, Artificial Sequence
  sgRNA
  Ubac2_14
tggaaaatcccatctccatg

SEQ ID NO: 63474 - DNA, 20 bp, Artificial Sequence
  sgRNA
  Ubac2_15
ggtggacctggagcactttg

SEQ ID NO: 63475 - DNA, 20 bp, Artificial Sequence
  sgRNA
  Ubac2_16
tgctcttcagaaacttccag

SEQ ID NO: 63476 - DNA, 20 bp, Artificial Sequence
  sgRNA
  Ubac2_17
caaagtgctccaggtccacc

SEQ ID NO: 63477 - DNA, 20 bp, Artificial Sequence
  sgRNA
  Ubac2_18
gcagcaggagagtcagcagg

SEQ ID NO: 63478 - DNA, 20 bp, Artificial Sequence
  sgRNA
  Ubac2_19
agcagaagactcttcgacag

SEQ ID NO: 63479 - DNA, 20 bp, Artificial Sequence
  sgRNA
  Ubac2_20
tatttcgtcgctgacgtaaa

SEQ ID NO: 63480 - DNA, 20 bp, Artificial Sequence
  sgRNA
  Ugt8a_1
gttgaccccaatgatatgtg

SEQ ID NO: 63481 - DNA, 20 bp, Artificial Sequence
  sgRNA
  Ugt8a_2
cagctactgacttaccaagc

SEQ ID NO: 63482 - DNA, 20 bp, Artificial Sequence
  sgRNA
  Ugt8a_3
ggaggctgtagtgattagat

SEQ ID NO: 63483 - DNA, 20 bp, Artificial Sequence
  sgRNA
  Ugt8a_4
gttatgtactgacgtagcac

SEQ ID NO: 63484 - DNA, 20 bp, Artificial Sequence
  sgRNA
  Ugt8a_5
gagtgctgttggaatagcaa

SEQ ID NO: 63485 - DNA, 20 bp, Artificial Sequence
  sgRNA
  Ugt8a_6
ctgtcaatcggactacctat

SEQ ID NO: 63486 - DNA, 20 bp, Artificial Sequence
  sgRNA
  Ugt8a_7
tctgatggacagcagaacgg

SEQ ID NO: 63487 - DNA, 20 bp, Artificial Sequence
  sgRNA
  Ugt8a_8
tggctttcaaacataattgg

SEQ ID NO: 63488 - DNA, 20 bp, Artificial Sequence
  sgRNA
  Ugt8a_9
ttacctcatatccagaatag

SEQ ID NO: 63489 - DNA, 20 bp, Artificial Sequence
  sgRNA
  Ugt8a_10
ggaaggctctgatatttgaa

SEQ ID NO: 63490 - DNA, 20 bp, Artificial Sequence
  sgRNA
  Ugt8a_11
ttaaaccctggattagggct

SEQ ID NO: 63491 - DNA, 20 bp, Artificial Sequence
  sgRNA
  Ugt8a_12
tggttctcccgaaatatgag

SEQ ID NO: 63492 - DNA, 20 bp, Artificial Sequence
  sgRNA
  Ugt8a_13
aagaatgtagtctatccaat

SEQ ID NO: 63493 - DNA, 20 bp, Artificial Sequence
  sgRNA
  Ugt8a_14
acaacactaagctcatagaa

SEQ ID NO: 63494 - DNA, 20 bp, Artificial Sequence
  sgRNA
  Ugt8a_15
gcatcggccttgcacgagag

SEQ ID NO: 63495 - DNA, 20 bp, Artificial Sequence
  sgRNA
  Ugt8a_16
ctattccaacagcactccac

SEQ ID NO: 63496 - DNA, 20 bp, Artificial Sequence
  sgRNA
  Ugt8a_17
cataatggtctccaaacagt

SEQ ID NO: 63497 - DNA, 20 bp, Artificial Sequence
  sgRNA
  Ugt8a_18
caccagctccaaaagacacc

SEQ ID NO: 63498 - DNA, 20 bp, Artificial Sequence
  sgRNA
  Ugt8a_19
gaggctgtagtgattagatg

SEQ ID NO: 63499 - DNA, 20 bp, Artificial Sequence
  sgRNA
  Ugt8a_20
gcacaaaggcaatatccagt

SEQ ID NO: 63500 - DNA, 20 bp, Artificial Sequence
  sgRNA
  Ulbp1_1
gaagtttatagaaatgtgca

SEQ ID NO: 63501 - DNA, 20 bp, Artificial Sequence
  sgRNA
  Ulbp1_2
ttccgtgttgacacaagcac

SEQ ID NO: 63502 - DNA, 20 bp, Artificial Sequence
  sgRNA
  Ulbp1_3
cacgcatagaataatcatca

SEQ ID NO: 63503 - DNA, 20 bp, Artificial Sequence
  sgRNA
  Ulbp1_4
gtgcaggagactaacacaac

SEQ ID NO: 63504 - DNA, 20 bp, Artificial Sequence
  sgRNA
  Ulbp1_5
tgacttcagacgatattgat

SEQ ID NO: 63505 - DNA, 20 bp, Artificial Sequence
  sgRNA
  Ulbp1_6
acaggtgacttcaacttccg

SEQ ID NO: 63506 - DNA, 20 bp, Artificial Sequence
  sgRNA
  Ulbp1_7
tctgctgcttcacatagtgc

SEQ ID NO: 63507 - DNA, 20 bp, Artificial Sequence
  sgRNA
  Ulbp1_8
gcctttctcggattgatctt

SEQ ID NO: 63508 - DNA, 20 bp, Artificial Sequence
  sgRNA
  Ulbp1_9
tctcgaattcatgatccagt

SEQ ID NO: 63509 - DNA, 20 bp, Artificial Sequence
  sgRNA
  Ulbp1_10
gtcaaagagtcatccaagag

SEQ ID NO: 63510 - DNA, 20 bp, Artificial Sequence
  sgRNA
  Ulbp1_11
acagaattctgagatgctgt

SEQ ID NO: 63511 - DNA, 20 bp, Artificial Sequence
  sgRNA
  Ulbp1_12
gagtcatccaagagaggtgg

SEQ ID NO: 63512 - DNA, 20 bp, Artificial Sequence
  sgRNA
  Ulbp1_13
ttgacttcagacgatattga

SEQ ID NO: 63513 - DNA, 20 bp, Artificial Sequence
  sgRNA
  Ulbp1_14
cacctcagcctgcagagtga

SEQ ID NO: 63514 - DNA, 20 bp, Artificial Sequence
  sgRNA
  Ulbp1_15
ctcgaattcatgatccagtt

SEQ ID NO: 63515 - DNA, 20 bp, Artificial Sequence
  sgRNA
  Ulbp1_16
gataaaaagtgtcatgccat

SEQ ID NO: 63516 - DNA, 20 bp, Artificial Sequence
  sgRNA
  Ulbp1_17
tgattcaatgtctctgtcct

SEQ ID NO: 63517 - DNA, 20 bp, Artificial Sequence
  sgRNA
  Ulbp1_18
gtcatgccattggtgctcat

SEQ ID NO: 63518 - DNA, 20 bp, Artificial Sequence
  sgRNA
  Ulbp1_19
agaaatgtgcaaggaagaca

SEQ ID NO: 63519 - DNA, 20 bp, Artificial Sequence
  sgRNA
  Ulbp1_20
acctcagcctgcagagtgag

SEQ ID NO: 63520 - DNA, 20 bp, Artificial Sequence
  sgRNA
  Umod_1
ggagcacttaaacgagcccg

SEQ ID NO: 63521 - DNA, 20 bp, Artificial Sequence
  sgRNA
  Umod_2
acaatgccttcactactcga

SEQ ID NO: 63522 - DNA, 20 bp, Artificial Sequence
  sgRNA
  Umod_3
gtaagccagattgcactcag

SEQ ID NO: 63523 - DNA, 20 bp, Artificial Sequence
  sgRNA
  Umod_4
gtgtcccgagggctttacag

SEQ ID NO: 63524 - DNA, 20 bp, Artificial Sequence
  sgRNA
  Umod_5
gttcactcgtagagtcacat

SEQ ID NO: 63525 - DNA, 20 bp, Artificial Sequence
  sgRNA
  Umod_6
cgtcctgcgatgcaacacgg

SEQ ID NO: 63526 - DNA, 20 bp, Artificial Sequence
  sgRNA
  Umod_7
ctggaacaatgccatccgca

SEQ ID NO: 63527 - DNA, 20 bp, Artificial Sequence
  sgRNA
  Umod_8
ggacaggcaagttcaccgtg

SEQ ID NO: 63528 - DNA, 20 bp, Artificial Sequence
  sgRNA
  Umod_9
gggtctgtggagttgctact

SEQ ID NO: 63529 - DNA, 20 bp, Artificial Sequence
  sgRNA
  Umod_10
gcccgtcctgcgatgcaaca

SEQ ID NO: 63530 - DNA, 20 bp, Artificial Sequence
  sgRNA
  Umod_11
caacaacgccacctgcacgg

SEQ ID NO: 63531 - DNA, 20 bp, Artificial Sequence
  sgRNA
  Umod_12
tccagtgtgcacaggccgtg

SEQ ID NO: 63532 - DNA, 20 bp, Artificial Sequence
  sgRNA
  Umod_13
gaatgatgatcgcatttgcc

SEQ ID NO: 63533 - DNA, 20 bp, Artificial Sequence
  sgRNA
  Umod_14
gctgcgccagtactcagtca

SEQ ID NO: 63534 - DNA, 20 bp, Artificial Sequence
  sgRNA
  Umod_15
ggtaacctcctggttcactc

SEQ ID NO: 63535 - DNA, 20 bp, Artificial Sequence
  sgRNA
  Umod_16
tgtgggctactcctgtgacg

SEQ ID NO: 63536 - DNA, 20 bp, Artificial Sequence
  sgRNA
  Umod_17
gggtctcatatgtattgcag

SEQ ID NO: 63537 - DNA, 20 bp, Artificial Sequence
  sgRNA
  Umod_18
actgggtgtggcatagcagt

SEQ ID NO: 63538 - DNA, 20 bp, Artificial Sequence
  sgRNA
  Umod_19
ggctgactttcatgtccaga

SEQ ID NO: 63539 - DNA, 20 bp, Artificial Sequence
  sgRNA
  Umod_20
ggagcgaccaatgctgccgg

SEQ ID NO: 63540 - DNA, 20 bp, Artificial Sequence
  sgRNA
  Umodl1_1
tgaactgtctgtaacaacga

SEQ ID NO: 63541 - DNA, 20 bp, Artificial Sequence
  sgRNA
  Umodl1_2
gtgccacacaacatagcccg

SEQ ID NO: 63542 - DNA, 20 bp, Artificial Sequence
  sgRNA
  Umodl1_3
ggtcccgggagtttgcatcg

SEQ ID NO: 63543 - DNA, 20 bp, Artificial Sequence
  sgRNA
  Umodl1_4
cccgaggagagaccaatgtg

SEQ ID NO: 63544 - DNA, 20 bp, Artificial Sequence
  sgRNA
  Umodl1_5
gagaccgtgacctttccaat

SEQ ID NO: 63545 - DNA, 20 bp, Artificial Sequence
  sgRNA
  Umodl1_6
tgatgaagctgaaggttacg

SEQ ID NO: 63546 - DNA, 20 bp, Artificial Sequence
  sgRNA
  Umodl1_7
tgacaaaatttccagtcccg

SEQ ID NO: 63547 - DNA, 20 bp, Artificial Sequence
  sgRNA
  Umodl1_8
gatgtctgcaggccactcga

SEQ ID NO: 63548 - DNA, 20 bp, Artificial Sequence
  sgRNA
  Umodl1_9
ggaacttagtgactcggtga

SEQ ID NO: 63549 - DNA, 20 bp, Artificial Sequence
  sgRNA
  Umodl1_10
ccatcctccacagtacacgt

SEQ ID NO: 63550 - DNA, 20 bp, Artificial Sequence
  sgRNA
  Umodl1_11
agaaacttgccggtaacgtc

SEQ ID NO: 63551 - DNA, 20 bp, Artificial Sequence
  sgRNA
  Umodl1_12
gctctgtaagagagcagtgt

SEQ ID NO: 63552 - DNA, 20 bp, Artificial Sequence
  sgRNA
  Umodl1_13
ggagtttgcatcgaggcccg

SEQ ID NO: 63553 - DNA, 20 bp, Artificial Sequence
  sgRNA
  Umodl1_14
agtgccacgaaatctcggat

SEQ ID NO: 63554 - DNA, 20 bp, Artificial Sequence
  sgRNA
  Umodl1_15
actcagggacatccatcgct

SEQ ID NO: 63555 - DNA, 20 bp, Artificial Sequence
  sgRNA
  Umodl1_16
gtacacgtaggctgtgtgag

SEQ ID NO: 63556 - DNA, 20 bp, Artificial Sequence
  sgRNA
  Umodl1_17
cttcactacttctcagcgac

SEQ ID NO: 63557 - DNA, 20 bp, Artificial Sequence
  sgRNA
  Umodl1_18
tgtagtcttgtggagttcgg

SEQ ID NO: 63558 - DNA, 20 bp, Artificial Sequence
  sgRNA
  Umodl1_19
ccagaagtgcagctgccgct

SEQ ID NO: 63559 - DNA, 20 bp, Artificial Sequence
  sgRNA
  Umodl1_20
agacccatggaacccatcag

SEQ ID NO: 63560 - DNA, 20 bp, Artificial Sequence
  sgRNA
  Unc5a_1
ctgcgtggccaagaacatcg

SEQ ID NO: 63561 - DNA, 20 bp, Artificial Sequence
  sgRNA
  Unc5a_2
tctcgtagatctttcctcgg

SEQ ID NO: 63562 - DNA, 20 bp, Artificial Sequence
  sgRNA
  Unc5a_3
aacccggcacctctcaacgg

SEQ ID NO: 63563 - DNA, 20 bp, Artificial Sequence
  sgRNA
  Unc5a_4
agcaggattgccaaccatgg

SEQ ID NO: 63564 - DNA, 20 bp, Artificial Sequence
  sgRNA
  Unc5a_5
ggaagtgccgcgcctcccat

SEQ ID NO: 63565 - DNA, 20 bp, Artificial Sequence
  sgRNA
  Unc5a_6
ccttgccatggaccactgcg

SEQ ID NO: 63566 - DNA, 20 bp, Artificial Sequence
  sgRNA
  Unc5a_7
gccatgttgctggtaccgcg

SEQ ID NO: 63567 - DNA, 20 bp, Artificial Sequence
  sgRNA
  Unc5a_8
tactttcgttctctgccccg

SEQ ID NO: 63568 - DNA, 20 bp, Artificial Sequence
  sgRNA
  Unc5a_9
cgtcgtggatggacagacgt

SEQ ID NO: 63569 - DNA, 20 bp, Artificial Sequence
  sgRNA
  Unc5a_10
ggaaggactggactcagacg

SEQ ID NO: 63570 - DNA, 20 bp, Artificial Sequence
  sgRNA
  Unc5a_11
gggaccttcaacttcctcgg

SEQ ID NO: 63571 - DNA, 20 bp, Artificial Sequence
  sgRNA
  Unc5a_12
ccatctgctcaccatccaac

SEQ ID NO: 63572 - DNA, 20 bp, Artificial Sequence
  sgRNA
  Unc5a_13
tcatctctactactgccagc

SEQ ID NO: 63573 - DNA, 20 bp, Artificial Sequence
  sgRNA
  Unc5a_14
tgtgctaccttgtcgccccc

SEQ ID NO: 63574 - DNA, 20 bp, Artificial Sequence
  sgRNA
  Unc5a_15
ggatcatcagccggcccccg

SEQ ID NO: 63575 - DNA, 20 bp, Artificial Sequence
  sgRNA
  Unc5a_16
catgatcctcaacctatggg

SEQ ID NO: 63576 - DNA, 20 bp, Artificial Sequence
  sgRNA
  Unc5a_17
gtgggtgcagtcaagcccgc

SEQ ID NO: 63577 - DNA, 20 bp, Artificial Sequence
  sgRNA
  Unc5a_18
gcacttgaagaagatctggg

SEQ ID NO: 63578 - DNA, 20 bp, Artificial Sequence
  sgRNA
  Unc5a_19
ccccaatgtgtacatcacac

SEQ ID NO: 63579 - DNA, 20 bp, Artificial Sequence
  sgRNA
  Unc5a_20
ctacatcggcctcgtcgccg

SEQ ID NO: 63580 - DNA, 20 bp, Artificial Sequence
  sgRNA
  Unc5b_1
gcaggggcgaattagtcatg

SEQ ID NO: 63581 - DNA, 20 bp, Artificial Sequence
  sgRNA
  Unc5b_2
cacaccatagacgatgactg

SEQ ID NO: 63582 - DNA, 20 bp, Artificial Sequence
  sgRNA
  Unc5b_3
ggaggaactcttcgggctcg

SEQ ID NO: 63583 - DNA, 20 bp, Artificial Sequence
  sgRNA
  Unc5b_4
cctgtatctacatatcaaca

SEQ ID NO: 63584 - DNA, 20 bp, Artificial Sequence
  sgRNA
  Unc5b_5
agaatatcgtggccaagcgc

SEQ ID NO: 63585 - DNA, 20 bp, Artificial Sequence
  sgRNA
  Unc5b_6
gcaccgccaccccagaacgg

SEQ ID NO: 63586 - DNA, 20 bp, Artificial Sequence
  sgRNA
  Unc5b_7
ccaaatggagccattcccca

SEQ ID NO: 63587 - DNA, 20 bp, Artificial Sequence
  sgRNA
  Unc5b_8
ggtggtgatggcattgcccg

SEQ ID NO: 63588 - DNA, 20 bp, Artificial Sequence
  sgRNA
  Unc5b_9
ccacaacctcatcatccgcc

SEQ ID NO: 63589 - DNA, 20 bp, Artificial Sequence
  sgRNA
  Unc5b_10
ccacaaagacggccaccaca

SEQ ID NO: 63590 - DNA, 20 bp, Artificial Sequence
  sgRNA
  Unc5b_11
ggactactggtgccagtgcg

SEQ ID NO: 63591 - DNA, 20 bp, Artificial Sequence
  sgRNA
  Unc5b_12
cctgttgccgagcttcccag

SEQ ID NO: 63592 - DNA, 20 bp, Artificial Sequence
  sgRNA
  Unc5b_13
ccggtatacgatcactccca

SEQ ID NO: 63593 - DNA, 20 bp, Artificial Sequence
  sgRNA
  Unc5b_14
gtacggcagctgctccgcag

SEQ ID NO: 63594 - DNA, 20 bp, Artificial Sequence
  sgRNA
  Unc5b_15
ggaagttagtgtcctgagcg

SEQ ID NO: 63595 - DNA, 20 bp, Artificial Sequence
  sgRNA
  Unc5b_16
atagacgatgactgtggccg

SEQ ID NO: 63596 - DNA, 20 bp, Artificial Sequence
  sgRNA
  Unc5b_17
gtcagcctgttggtaccaaa

SEQ ID NO: 63597 - DNA, 20 bp, Artificial Sequence
  sgRNA
  Unc5b_18
aatccagccccactcaatgg

SEQ ID NO: 63598 - DNA, 20 bp, Artificial Sequence
  sgRNA
  Unc5b_19
agtacggcagctgctccgca

SEQ ID NO: 63599 - DNA, 20 bp, Artificial Sequence
  sgRNA
  Unc5b_20
tgaagtagatctgcgtggca

SEQ ID NO: 63600 - DNA, 20 bp, Artificial Sequence
  sgRNA
  Unc5c_1
aggcactacgaagagtcgga

SEQ ID NO: 63601 - DNA, 20 bp, Artificial Sequence
  sgRNA
  Unc5c_2
cttaccatacacgatgacag

SEQ ID NO: 63602 - DNA, 20 bp, Artificial Sequence
  sgRNA
  Unc5c_3
tcagaccctacttacccctg

SEQ ID NO: 63603 - DNA, 20 bp, Artificial Sequence
  sgRNA
  Unc5c_4
atgatgtggctctctacgtg

SEQ ID NO: 63604 - DNA, 20 bp, Artificial Sequence
  sgRNA
  Unc5c_5
gcaccagcccccaagaacgg

SEQ ID NO: 63605 - DNA, 20 bp, Artificial Sequence
  sgRNA
  Unc5c_6
tctgatatcctcgcccacag

SEQ ID NO: 63606 - DNA, 20 bp, Artificial Sequence
  sgRNA
  Unc5c_7
catccagctgaatgtaacag

SEQ ID NO: 63607 - DNA, 20 bp, Artificial Sequence
  sgRNA
  Unc5c_8
agatgatgtggctctctacg

SEQ ID NO: 63608 - DNA, 20 bp, Artificial Sequence
  sgRNA
  Unc5c_9
tgtcatgaatagacaggcgc

SEQ ID NO: 63609 - DNA, 20 bp, Artificial Sequence
  sgRNA
  Unc5c_10
tgtcagactcaaagtcacgg

SEQ ID NO: 63610 - DNA, 20 bp, Artificial Sequence
  sgRNA
  Unc5c_11
gtgggtgcattcagtcccac

SEQ ID NO: 63611 - DNA, 20 bp, Artificial Sequence
  sgRNA
  Unc5c_12
gttcttccgatacacaaaca

SEQ ID NO: 63612 - DNA, 20 bp, Artificial Sequence
  sgRNA
  Unc5c_13
cagcaggcactacgaagagt

SEQ ID NO: 63613 - DNA, 20 bp, Artificial Sequence
  sgRNA
  Unc5c_14
acttcaagtgcaacagcgag

SEQ ID NO: 63614 - DNA, 20 bp, Artificial Sequence
  sgRNA
  Unc5c_15
ggtaccttcaactctcttgg

SEQ ID NO: 63615 - DNA, 20 bp, Artificial Sequence
  sgRNA
  Unc5c_16
agtaccatcaccactgtcac

SEQ ID NO: 63616 - DNA, 20 bp, Artificial Sequence
  sgRNA
  Unc5c_17
ggagcaaatggtcaacctgt

SEQ ID NO: 63617 - DNA, 20 bp, Artificial Sequence
  sgRNA
  Unc5c_18
atgcacccactggcgcagga

SEQ ID NO: 63618 - DNA, 20 bp, Artificial Sequence
  sgRNA
  Unc5c_19
gactcctcagcactcaatgg

SEQ ID NO: 63619 - DNA, 20 bp, Artificial Sequence
  sgRNA
  Unc5c_20
gctggcccataaactcaacc

SEQ ID NO: 63620 - DNA, 20 bp, Artificial Sequence
  sgRNA
  Unc5d_1
accatggcaagaatcactcg

SEQ ID NO: 63621 - DNA, 20 bp, Artificial Sequence
  sgRNA
  Unc5d_2
gtgagtctactcataccaca

SEQ ID NO: 63622 - DNA, 20 bp, Artificial Sequence
  sgRNA
  Unc5d_3
ctgtatggcagccaacatcg

SEQ ID NO: 63623 - DNA, 20 bp, Artificial Sequence
  sgRNA
  Unc5d_4
acctgggaacgtccaagagt

SEQ ID NO: 63624 - DNA, 20 bp, Artificial Sequence
  sgRNA
  Unc5d_5
gatgtattgtactgaatccg

SEQ ID NO: 63625 - DNA, 20 bp, Artificial Sequence
  sgRNA
  Unc5d_6
gctgatgacgagcttcccag

SEQ ID NO: 63626 - DNA, 20 bp, Artificial Sequence
  sgRNA
  Unc5d_7
tcagcctgcaatgttcgctg

SEQ ID NO: 63627 - DNA, 20 bp, Artificial Sequence
  sgRNA
  Unc5d_8
agaccaccacagttgctgag

SEQ ID NO: 63628 - DNA, 20 bp, Artificial Sequence
  sgRNA
  Unc5d_9
tcatcctgttcggagtcgat

SEQ ID NO: 63629 - DNA, 20 bp, Artificial Sequence
  sgRNA
  Unc5d_10
ggttcaaaatgacagcggaa

SEQ ID NO: 63630 - DNA, 20 bp, Artificial Sequence
  sgRNA
  Unc5d_11
aacgctgcctcatttcatcg

SEQ ID NO: 63631 - DNA, 20 bp, Artificial Sequence
  sgRNA
  Unc5d_12
acttgatcatcagacaggcc

SEQ ID NO: 63632 - DNA, 20 bp, Artificial Sequence
  sgRNA
  Unc5d_13
ataggaacctccctgccttg

SEQ ID NO: 63633 - DNA, 20 bp, Artificial Sequence
  sgRNA
  Unc5d_14
tcgggctcctcgatgaaatg

SEQ ID NO: 63634 - DNA, 20 bp, Artificial Sequence
  sgRNA
  Unc5d_15
tttgataccccaaatgccaa

SEQ ID NO: 63635 - DNA, 20 bp, Artificial Sequence
  sgRNA
  Unc5d_16
ggtggctccacgctacacac

SEQ ID NO: 63636 - DNA, 20 bp, Artificial Sequence
  sgRNA
  Unc5d_17
aggaagtgatttctgacgaa

SEQ ID NO: 63637 - DNA, 20 bp, Artificial Sequence
  sgRNA
  Unc5d_18
aacttgcccccatttcttgg

SEQ ID NO: 63638 - DNA, 20 bp, Artificial Sequence
  sgRNA
  Unc5d_19
aagtgtttatcaatgtcacc

SEQ ID NO: 63639 - DNA, 20 bp, Artificial Sequence
  sgRNA
  Unc5d_20
acaagatccacaaggcaggg

SEQ ID NO: 63640 - DNA, 20 bp, Artificial Sequence
  sgRNA
  Unc93a_1
ctttgtagaagccatcccag

SEQ ID NO: 63641 - DNA, 20 bp, Artificial Sequence
  sgRNA
  Unc93a_2
gcccacaaagtggataccca

SEQ ID NO: 63642 - DNA, 20 bp, Artificial Sequence
  sgRNA
  Unc93a_3
agtaatgtggaccaaagagg

SEQ ID NO: 63643 - DNA, 20 bp, Artificial Sequence
  sgRNA
  Unc93a_4
ggggaagcttggcaaagatg

SEQ ID NO: 63644 - DNA, 20 bp, Artificial Sequence
  sgRNA
  Unc93a_5
tgaggggtgatgagtactgt

SEQ ID NO: 63645 - DNA, 20 bp, Artificial Sequence
  sgRNA
  Unc93a_6
ctccaagtacacgggcaggg

SEQ ID NO: 63646 - DNA, 20 bp, Artificial Sequence
  sgRNA
  Unc93a_7
ggggtgatgagtactgttgg

SEQ ID NO: 63647 - DNA, 20 bp, Artificial Sequence
  sgRNA
  Unc93a_8
tgagtactgttggtggccgc

SEQ ID NO: 63648 - DNA, 20 bp, Artificial Sequence
  sgRNA
  Unc93a_9
gccctgggtatccactttgt

SEQ ID NO: 63649 - DNA, 20 bp, Artificial Sequence
  sgRNA
  Unc93a_10
agggcggcgctctatgcact

SEQ ID NO: 63650 - DNA, 20 bp, Artificial Sequence
  sgRNA
  Unc93a_11
aaagtggatacccagggcac

SEQ ID NO: 63651 - DNA, 20 bp, Artificial Sequence
  sgRNA
  Unc93a_12
cagggcggcgctctatgcac

SEQ ID NO: 63652 - DNA, 20 bp, Artificial Sequence
  sgRNA
  Unc93a_13
agcccacaaagtggataccc

SEQ ID NO: 63653 - DNA, 20 bp, Artificial Sequence
  sgRNA
  Unc93a_14
tgccctgggtatccactttg

SEQ ID NO: 63654 - DNA, 20 bp, Artificial Sequence
  sgRNA
  Unc93a_15
cgccgccctgcccgtgtact

SEQ ID NO: 63655 - DNA, 20 bp, Artificial Sequence
  sgRNA
  Unc93a2_1
tctgatgtagatgatgctca

SEQ ID NO: 63656 - DNA, 20 bp, Artificial Sequence
  sgRNA
  Unc93a2_2
gggtgcagcccctctgtggt

SEQ ID NO: 63657 - DNA, 20 bp, Artificial Sequence
  sgRNA
  Unc93a2_3
accacagaggggctgcaccc

SEQ ID NO: 63658 - DNA, 20 bp, Artificial Sequence
  sgRNA
  Unc93a2_4
cacaacgcaagagaagtgaa

SEQ ID NO: 63659 - DNA, 20 bp, Artificial Sequence
  sgRNA
  Unc93a2_5
agggctgcgctctatgcact

SEQ ID NO: 63660 - DNA, 20 bp, Artificial Sequence
  sgRNA
  Unc93a2_6
cattcacttctcttgcgttg

SEQ ID NO: 63661 - DNA, 20 bp, Artificial Sequence
  sgRNA
  Unc93a2_7
gcctgggtgcagcccctctg

SEQ ID NO: 63662 - DNA, 20 bp, Artificial Sequence
  sgRNA
  Unc93a2_8
gcgttgtggtcttcctgctg

SEQ ID NO: 63663 - DNA, 20 bp, Artificial Sequence
  sgRNA
  Unc93a2_9
cagggctgcgctctatgcac

SEQ ID NO: 63664 - DNA, 20 bp, Artificial Sequence
  sgRNA
  Unc93a2_10
tgcacccaggcccagcaaga

SEQ ID NO: 63665 - DNA, 20 bp, Artificial Sequence
  sgRNA
  Unc93a2_11
atctgatgtagatgatgctc

SEQ ID NO: 63666 - DNA, 20 bp, Artificial Sequence
  sgRNA
  Unc93a2_12
cgcagccctgcccgtgtact

SEQ ID NO: 63667 - DNA, 20 bp, Artificial Sequence
  sgRNA
  Unc93a2_13
agcccctctgtggtcggctc

SEQ ID NO: 63668 - DNA, 20 bp, Artificial Sequence
  sgRNA
  Unc93b1_1
ctgggaacgctactacacgc

SEQ ID NO: 63669 - DNA, 20 bp, Artificial Sequence
  sgRNA
  Unc93b1_2
ccgcagttggacgaactcgt

SEQ ID NO: 63670 - DNA, 20 bp, Artificial Sequence
  sgRNA
  Unc93b1_3
aggtgaagtatggcaacatg

SEQ ID NO: 63671 - DNA, 20 bp, Artificial Sequence
  sgRNA
  Unc93b1_4
gcacacgcgaagctcaactg

SEQ ID NO: 63672 - DNA, 20 bp, Artificial Sequence
  sgRNA
  Unc93b1_5
gtagtagcgttcccagtagt

SEQ ID NO: 63673 - DNA, 20 bp, Artificial Sequence
  sgRNA
  Unc93b1_6
gctacggcgtgtgctccatg

SEQ ID NO: 63674 - DNA, 20 bp, Artificial Sequence
  sgRNA
  Unc93b1_7
cctccaggtagcggtagccg

SEQ ID NO: 63675 - DNA, 20 bp, Artificial Sequence
  sgRNA
  Unc93b1_8
gcttcaacaagacggtcctt

SEQ ID NO: 63676 - DNA, 20 bp, Artificial Sequence
  sgRNA
  Unc93b1_9
ccgcggctaccgctacctgg

SEQ ID NO: 63677 - DNA, 20 bp, Artificial Sequence
  sgRNA
  Unc93b1_10
gcacgttcttgaccactccg

SEQ ID NO: 63678 - DNA, 20 bp, Artificial Sequence
  sgRNA
  Unc93b1_11
gcgcaggtcgatctcttccg

SEQ ID NO: 63679 - DNA, 20 bp, Artificial Sequence
  sgRNA
  Unc93b1_12
ctatcactggtggcaggccg

SEQ ID NO: 63680 - DNA, 20 bp, Artificial Sequence
  sgRNA
  Unc93b1_13
aagccactgtagataaagaa

SEQ ID NO: 63681 - DNA, 20 bp, Artificial Sequence
  sgRNA
  Unc93b1_14
tgcagcaaggattggtcccg

SEQ ID NO: 63682 - DNA, 20 bp, Artificial Sequence
  sgRNA
  Unc93b1_15
agtcctgccccagccacgag

SEQ ID NO: 63683 - DNA, 20 bp, Artificial Sequence
  sgRNA
  Unc93b1_16
gtgcccttctttatctacag

SEQ ID NO: 63684 - DNA, 20 bp, Artificial Sequence
  sgRNA
  Unc93b1_17
ctatgaatactcccactaca

SEQ ID NO: 63685 - DNA, 20 bp, Artificial Sequence
  sgRNA
  Unc93b1_18
acgggtgtcacccttactta

SEQ ID NO: 63686 - DNA, 20 bp, Artificial Sequence
  sgRNA
  Unc93b1_19
gtgtgtggttcaggtcatac

SEQ ID NO: 63687 - DNA, 20 bp, Artificial Sequence
  sgRNA
  Unc93b1_20
tcccagcagccccagaaccg

SEQ ID NO: 63688 - DNA, 20 bp, Artificial Sequence
  sgRNA
  Upk1a_1
gaccggatcatgattgaggt

SEQ ID NO: 63689 - DNA, 20 bp, Artificial Sequence
  sgRNA
  Upk1a_2
cgcccatcagtgggtacacg

SEQ ID NO: 63690 - DNA, 20 bp, Artificial Sequence
  sgRNA
  Upk1a_3
ccacactgtctccgcaaaca

SEQ ID NO: 63691 - DNA, 20 bp, Artificial Sequence
  sgRNA
  Upk1a_4
ccccactcacatagtcgcgg

SEQ ID NO: 63692 - DNA, 20 bp, Artificial Sequence
  sgRNA
  Upk1a_5
tgtaattcacccagtccatg

SEQ ID NO: 63693 - DNA, 20 bp, Artificial Sequence
  sgRNA
  Upk1a_6
atgccattgatagctacacg

SEQ ID NO: 63694 - DNA, 20 bp, Artificial Sequence
  sgRNA
  Upk1a_7
tgccattgatagctacacgt

SEQ ID NO: 63695 - DNA, 20 bp, Artificial Sequence
  sgRNA
  Upk1a_8
gtaccgcgtgtacccactga

SEQ ID NO: 63696 - DNA, 20 bp, Artificial Sequence
  sgRNA
  Upk1a_9
acatggctatcaacatcaca

SEQ ID NO: 63697 - DNA, 20 bp, Artificial Sequence
  sgRNA
  Upk1a_10
gctacacgtggggcatatcg

SEQ ID NO: 63698 - DNA, 20 bp, Artificial Sequence
  sgRNA
  Upk1a_11
gccccacgtgtagctatcaa

SEQ ID NO: 63699 - DNA, 20 bp, Artificial Sequence
  sgRNA
  Upk1a_12
ggtagtccatgtggcctact

SEQ ID NO: 63700 - DNA, 20 bp, Artificial Sequence
  sgRNA
  Upk1a_13
gtccgacgacagcacagtgg

SEQ ID NO: 63701 - DNA, 20 bp, Artificial Sequence
  sgRNA
  Upk1a_14
ccacgggaacaccacttccg

SEQ ID NO: 63702 - DNA, 20 bp, Artificial Sequence
  sgRNA
  Upk1a_15
cggcttctccttcttcgtcg

SEQ ID NO: 63703 - DNA, 20 bp, Artificial Sequence
  sgRNA
  Upk1a_16
gtagtaggtcaacatttgct

SEQ ID NO: 63704 - DNA, 20 bp, Artificial Sequence
  sgRNA
  Upk1a_17
acgtgtagctatcaatggca

SEQ ID NO: 63705 - DNA, 20 bp, Artificial Sequence
  sgRNA
  Upk1a_18
gtgtaattcacccagtccat

SEQ ID NO: 63706 - DNA, 20 bp, Artificial Sequence
  sgRNA
  Upk1a_19
agacgatgagcatcagcagc

SEQ ID NO: 63707 - DNA, 20 bp, Artificial Sequence
  sgRNA
  Upk1a_20
gagctgcgctctgtcgtcgt

SEQ ID NO: 63708 - DNA, 20 bp, Artificial Sequence
  sgRNA
  Upk1b_1
cgacgaatggaagaacaacg

SEQ ID NO: 63709 - DNA, 20 bp, Artificial Sequence
  sgRNA
  Upk1b_2
gcttggataggcatgttcgt

SEQ ID NO: 63710 - DNA, 20 bp, Artificial Sequence
  sgRNA
  Upk1b_3
gtgtatttctgccagtctga

SEQ ID NO: 63711 - DNA, 20 bp, Artificial Sequence
  sgRNA
  Upk1b_4
tgtaaggtcttaccgccaag

SEQ ID NO: 63712 - DNA, 20 bp, Artificial Sequence
  sgRNA
  Upk1b_5
ataacgatgctgactacccc

SEQ ID NO: 63713 - DNA, 20 bp, Artificial Sequence
  sgRNA
  Upk1b_6
tccatgacgcagcactgccg

SEQ ID NO: 63714 - DNA, 20 bp, Artificial Sequence
  sgRNA
  Upk1b_7
ttgcaagcgtccaggttgag

SEQ ID NO: 63715 - DNA, 20 bp, Artificial Sequence
  sgRNA
  Upk1b_8
atcgttattctccacccgga

SEQ ID NO: 63716 - DNA, 20 bp, Artificial Sequence
  sgRNA
  Upk1b_9
atacacctctgccttccggg

SEQ ID NO: 63717 - DNA, 20 bp, Artificial Sequence
  sgRNA
  Upk1b_10
gccctggaagcaacgaacag

SEQ ID NO: 63718 - DNA, 20 bp, Artificial Sequence
  sgRNA
  Upk1b_11
gcttaaagagcctctcaacc

SEQ ID NO: 63719 - DNA, 20 bp, Artificial Sequence
  sgRNA
  Upk1b_12
ttacgtgtccaaaaatcaac

SEQ ID NO: 63720 - DNA, 20 bp, Artificial Sequence
  sgRNA
  Upk1b_13
tgatctctggaccaatggac

SEQ ID NO: 63721 - DNA, 20 bp, Artificial Sequence
  sgRNA
  Upk1b_14
taggaattatgaagtccaac

SEQ ID NO: 63722 - DNA, 20 bp, Artificial Sequence
  sgRNA
  Upk1b_15
ccccaaccaatgacgacgaa

SEQ ID NO: 63723 - DNA, 20 bp, Artificial Sequence
  sgRNA
  Upk1b_16
cattcgtcgtcattggttgg

SEQ ID NO: 63724 - DNA, 20 bp, Artificial Sequence
  sgRNA
  Upk1b_17
aattctgctccagtagaaca

SEQ ID NO: 63725 - DNA, 20 bp, Artificial Sequence
  sgRNA
  Upk1b_18
cagcatcgttattctccacc

SEQ ID NO: 63726 - DNA, 20 bp, Artificial Sequence
  sgRNA
  Upk1b_19
gaccgtttacaccacagcag

SEQ ID NO: 63727 - DNA, 20 bp, Artificial Sequence
  sgRNA
  Upk1b_20
gacgacgaatggaagaacaa

SEQ ID NO: 63728 - DNA, 20 bp, Artificial Sequence
  sgRNA
  Upk2_1
atgtggcattacctcccgtg

SEQ ID NO: 63729 - DNA, 20 bp, Artificial Sequence
  sgRNA
  Upk2_2
ggtctggctacaccgtcaca

SEQ ID NO: 63730 - DNA, 20 bp, Artificial Sequence
  sgRNA
  Upk2_3
tgtccccttctgtactcggt

SEQ ID NO: 63731 - DNA, 20 bp, Artificial Sequence
  sgRNA
  Upk2_4
tccctgcgcccgcgacatgg

SEQ ID NO: 63732 - DNA, 20 bp, Artificial Sequence
  sgRNA
  Upk2_5
atatgcgctgagccttgtga

SEQ ID NO: 63733 - DNA, 20 bp, Artificial Sequence
  sgRNA
  Upk2_6
tatcctaccgagtacagaag

SEQ ID NO: 63734 - DNA, 20 bp, Artificial Sequence
  sgRNA
  Upk2_7
gccagcagaatcaggatcag

SEQ ID NO: 63735 - DNA, 20 bp, Artificial Sequence
  sgRNA
  Upk2_8
cccccatgtcacctcacggg

SEQ ID NO: 63736 - DNA, 20 bp, Artificial Sequence
  sgRNA
  Upk2_9
catatcctaccgagtacaga

SEQ ID NO: 63737 - DNA, 20 bp, Artificial Sequence
  sgRNA
  Upk2_10
ggagtctattgggttaggaa

SEQ ID NO: 63738 - DNA, 20 bp, Artificial Sequence
  sgRNA
  Upk2_11
tttgtggtgcctccatgtcg

SEQ ID NO: 63739 - DNA, 20 bp, Artificial Sequence
  sgRNA
  Upk2_12
aatggcccggacaggaggga

SEQ ID NO: 63740 - DNA, 20 bp, Artificial Sequence
  sgRNA
  Upk2_13
aacaggctttctgttagcgc

SEQ ID NO: 63741 - DNA, 20 bp, Artificial Sequence
  sgRNA
  Upk2_14
gtctgtggccatgttcctgt

SEQ ID NO: 63742 - DNA, 20 bp, Artificial Sequence
  sgRNA
  Upk2_15
ggctctccggaccatcaatg

SEQ ID NO: 63743 - DNA, 20 bp, Artificial Sequence
  sgRNA
  Upk2_16
ttaggaatggcccggacagg

SEQ ID NO: 63744 - DNA, 20 bp, Artificial Sequence
  sgRNA
  Upk2_17
ctattgggttaggaatggcc

SEQ ID NO: 63745 - DNA, 20 bp, Artificial Sequence
  sgRNA
  Upk2_18
ttgtgagcgtggtggacagt

SEQ ID NO: 63746 - DNA, 20 bp, Artificial Sequence
  sgRNA
  Upk2_19
tgctggctgtcctggctccg

SEQ ID NO: 63747 - DNA, 20 bp, Artificial Sequence
  sgRNA
  Upk2_20
gccatgttcctgttggtcgt

SEQ ID NO: 63748 - DNA, 20 bp, Artificial Sequence
  sgRNA
  Upk3a_1
gaacgcatacctagtcaggg

SEQ ID NO: 63749 - DNA, 20 bp, Artificial Sequence
  sgRNA
  Upk3a_2
ttacgccggttggtccagat

SEQ ID NO: 63750 - DNA, 20 bp, Artificial Sequence
  sgRNA
  Upk3a_3
acctcgtaagagccgctgag

SEQ ID NO: 63751 - DNA, 20 bp, Artificial Sequence
  sgRNA
  Upk3a_4
caaaggccgcagctttatag

SEQ ID NO: 63752 - DNA, 20 bp, Artificial Sequence
  sgRNA
  Upk3a_5
gccactcagcggctcttacg

SEQ ID NO: 63753 - DNA, 20 bp, Artificial Sequence
  sgRNA
  Upk3a_6
acacgactcacagatcaccc

SEQ ID NO: 63754 - DNA, 20 bp, Artificial Sequence
  sgRNA
  Upk3a_7
tcctactcatctgtgaaccg

SEQ ID NO: 63755 - DNA, 20 bp, Artificial Sequence
  sgRNA
  Upk3a_8
acgtgtcgatggccgagtag

SEQ ID NO: 63756 - DNA, 20 bp, Artificial Sequence
  sgRNA
  Upk3a_9
ctgcaacccacccctgacag

SEQ ID NO: 63757 - DNA, 20 bp, Artificial Sequence
  sgRNA
  Upk3a_10
gctgggcaagtcaccacaag

SEQ ID NO: 63758 - DNA, 20 bp, Artificial Sequence
  sgRNA
  Upk3a_11
ctgcccttcttcctgctcgt

SEQ ID NO: 63759 - DNA, 20 bp, Artificial Sequence
  sgRNA
  Upk3a_12
cgaggtttacctctatgcta

SEQ ID NO: 63760 - DNA, 20 bp, Artificial Sequence
  sgRNA
  Upk3a_13
ctgagtcgaccatagcatag

SEQ ID NO: 63761 - DNA, 20 bp, Artificial Sequence
  sgRNA
  Upk3a_14
cctgaacgcatacctagtca

SEQ ID NO: 63762 - DNA, 20 bp, Artificial Sequence
  sgRNA
  Upk3a_15
gatagctcagagccactcag

SEQ ID NO: 63763 - DNA, 20 bp, Artificial Sequence
  sgRNA
  Upk3a_16
cctactcggccatcgacacg

SEQ ID NO: 63764 - DNA, 20 bp, Artificial Sequence
  sgRNA
  Upk3a_17
aaacccacgagcaggaagaa

SEQ ID NO: 63765 - DNA, 20 bp, Artificial Sequence
  sgRNA
  Upk3a_18
ggctgggcaagtcaccacaa

SEQ ID NO: 63766 - DNA, 20 bp, Artificial Sequence
  sgRNA
  Upk3a_19
gagctatcaaacatgcacag

SEQ ID NO: 63767 - DNA, 20 bp, Artificial Sequence
  sgRNA
  Upk3a_20
gtactcagtggccgctgtca

SEQ ID NO: 63768 - DNA, 20 bp, Artificial Sequence
  sgRNA
  Upk3b_1
ggctgttatctgcggcacgt

SEQ ID NO: 63769 - DNA, 20 bp, Artificial Sequence
  sgRNA
  Upk3b_2
cattgcccacccgaagcacg

SEQ ID NO: 63770 - DNA, 20 bp, Artificial Sequence
  sgRNA
  Upk3b_3
ttccttgtaatggatgccgc

SEQ ID NO: 63771 - DNA, 20 bp, Artificial Sequence
  sgRNA
  Upk3b_4
taaggacaccatctggctag

SEQ ID NO: 63772 - DNA, 20 bp, Artificial Sequence
  sgRNA
  Upk3b_5
tgctcatcaaagacgcaccg

SEQ ID NO: 63773 - DNA, 20 bp, Artificial Sequence
  sgRNA
  Upk3b_6
ccatgtgaggacctgaccgg

SEQ ID NO: 63774 - DNA, 20 bp, Artificial Sequence
  sgRNA
  Upk3b_7
tctcaactaaggacaccatc

SEQ ID NO: 63775 - DNA, 20 bp, Artificial Sequence
  sgRNA
  Upk3b_8
acatggcctggccgacggag

SEQ ID NO: 63776 - DNA, 20 bp, Artificial Sequence
  sgRNA
  Upk3b_9
gaagctgccacactgccggt

SEQ ID NO: 63777 - DNA, 20 bp, Artificial Sequence
  sgRNA
  Upk3b_10
ggtgtccccgtgcttcgggt

SEQ ID NO: 63778 - DNA, 20 bp, Artificial Sequence
  sgRNA
  Upk3b_11
ggatcttagcagcagtctgt

SEQ ID NO: 63779 - DNA, 20 bp, Artificial Sequence
  sgRNA
  Upk3b_12
gaaagccaccactagccaga

SEQ ID NO: 63780 - DNA, 20 bp, Artificial Sequence
  sgRNA
  Upk3b_13
acttcgtctcagccttgggt

SEQ ID NO: 63781 - DNA, 20 bp, Artificial Sequence
  sgRNA
  Upk3b_14
cgtgccgcagataacagcct

SEQ ID NO: 63782 - DNA, 20 bp, Artificial Sequence
  sgRNA
  Upk3b_15
ccaccggtcaggtcctcaca

SEQ ID NO: 63783 - DNA, 20 bp, Artificial Sequence
  sgRNA
  Upk3b_16
atcattgcccacccgaagca

SEQ ID NO: 63784 - DNA, 20 bp, Artificial Sequence
  sgRNA
  Upk3b_17
ttcccacagctgctgactga

SEQ ID NO: 63785 - DNA, 20 bp, Artificial Sequence
  sgRNA
  Upk3b_18
cgatcatacagccgctccgt

SEQ ID NO: 63786 - DNA, 20 bp, Artificial Sequence
  sgRNA
  Upk3b_19
cattctctctggagcagcct

SEQ ID NO: 63787 - DNA, 20 bp, Artificial Sequence
  sgRNA
  Upk3b_20
gctcctgagcagctgcggat

SEQ ID NO: 63788 - DNA, 20 bp, Artificial Sequence
  sgRNA
  Ush2a_1
atttcaatacctgtaatccg

SEQ ID NO: 63789 - DNA, 20 bp, Artificial Sequence
  sgRNA
  Ush2a_2
aggcgcatcccacctcacgt

SEQ ID NO: 63790 - DNA, 20 bp, Artificial Sequence
  sgRNA
  Ush2a_3
taagctatgagttatacatg

SEQ ID NO: 63791 - DNA, 20 bp, Artificial Sequence
  sgRNA
  Ush2a_4
ccttgccaatgtaacctcca

SEQ ID NO: 63792 - DNA, 20 bp, Artificial Sequence
  sgRNA
  Ush2a_5
gcataactgtacgttgagaa

SEQ ID NO: 63793 - DNA, 20 bp, Artificial Sequence
  sgRNA
  Ush2a_6
gccggcttccttcgatgccg

SEQ ID NO: 63794 - DNA, 20 bp, Artificial Sequence
  sgRNA
  Ush2a_7
aatgcagtactgctgaacgg

SEQ ID NO: 63795 - DNA, 20 bp, Artificial Sequence
  sgRNA
  Ush2a_8
gagccatctgagtatctgga

SEQ ID NO: 63796 - DNA, 20 bp, Artificial Sequence
  sgRNA
  Ush2a_9
tggctgctccgaatactcat

SEQ ID NO: 63797 - DNA, 20 bp, Artificial Sequence
  sgRNA
  Ush2a_10
gcccgtctctacgggctccg

SEQ ID NO: 63798 - DNA, 20 bp, Artificial Sequence
  sgRNA
  Ush2a_11
gtgactgccactaacagccg

SEQ ID NO: 63799 - DNA, 20 bp, Artificial Sequence
  sgRNA
  Ush2a_12
tattaggctgaagccccgcc

SEQ ID NO: 63800 - DNA, 20 bp, Artificial Sequence
  sgRNA
  Ush2a_13
gcgttctgacgtatgtccca

SEQ ID NO: 63801 - DNA, 20 bp, Artificial Sequence
  sgRNA
  Ush2a_14
gctggcaccagatacagtcg

SEQ ID NO: 63802 - DNA, 20 bp, Artificial Sequence
  sgRNA
  Ush2a_15
gctggcttccccgataaacc

SEQ ID NO: 63803 - DNA, 20 bp, Artificial Sequence
  sgRNA
  Ush2a_16
agtgatccgcagacgctcgg

SEQ ID NO: 63804 - DNA, 20 bp, Artificial Sequence
  sgRNA
  Ush2a_17
ctcactggaggtacacccga

SEQ ID NO: 63805 - DNA, 20 bp, Artificial Sequence
  sgRNA
  Ush2a_18
gcaacctccacccagaggat

SEQ ID NO: 63806 - DNA, 20 bp, Artificial Sequence
  sgRNA
  Ush2a_19
gtacaccctccgtcctccgt

SEQ ID NO: 63807 - DNA, 20 bp, Artificial Sequence
  sgRNA
  Ush2a_20
gtactacagtccatatcagg

SEQ ID NO: 63808 - DNA, 20 bp, Artificial Sequence
  sgRNA
  Vasn_1
tggggcagtcgatagtacgg

SEQ ID NO: 63809 - DNA, 20 bp, Artificial Sequence
  sgRNA
  Vasn_2
agaccttatagtaggtactg

SEQ ID NO: 63810 - DNA, 20 bp, Artificial Sequence
  sgRNA
  Vasn_3
tattgcccagatacggcccg

SEQ ID NO: 63811 - DNA, 20 bp, Artificial Sequence
  sgRNA
  Vasn_4
acatggttctcacgcaccca

SEQ ID NO: 63812 - DNA, 20 bp, Artificial Sequence
  sgRNA
  Vasn_5
agtggctgaaagatgccccc

SEQ ID NO: 63813 - DNA, 20 bp, Artificial Sequence
  sgRNA
  Vasn_6
tttgggagcaagacaccact

SEQ ID NO: 63814 - DNA, 20 bp, Artificial Sequence
  sgRNA
  Vasn_7
tgcctcttatgggctaccca

SEQ ID NO: 63815 - DNA, 20 bp, Artificial Sequence
  sgRNA
  Vasn_8
ccgaattcgccacatccaac

SEQ ID NO: 63816 - DNA, 20 bp, Artificial Sequence
  sgRNA
  Vasn_9
gcgcgtcgaaggcacccggt

SEQ ID NO: 63817 - DNA, 20 bp, Artificial Sequence
  sgRNA
  Vasn_10
gtctggccctgacaaacgac

SEQ ID NO: 63818 - DNA, 20 bp, Artificial Sequence
  sgRNA
  Vasn_11
ctgatagtagaccttatagt

SEQ ID NO: 63819 - DNA, 20 bp, Artificial Sequence
  sgRNA
  Vasn_12
tcaagcgcgtcgaaggcacc

SEQ ID NO: 63820 - DNA, 20 bp, Artificial Sequence
  sgRNA
  Vasn_13
cagatggcatatgctccaac

SEQ ID NO: 63821 - DNA, 20 bp, Artificial Sequence
  sgRNA
  Vasn_14
gcatccatctgcctgaatgg

SEQ ID NO: 63822 - DNA, 20 bp, Artificial Sequence
  sgRNA
  Vasn_15
agctgccagacaatgagctt

SEQ ID NO: 63823 - DNA, 20 bp, Artificial Sequence
  sgRNA
  Vasn_16
tctatctgtgtcacaccctt

SEQ ID NO: 63824 - DNA, 20 bp, Artificial Sequence
  sgRNA
  Vasn_17
tgtgacacagatagaatagg

SEQ ID NO: 63825 - DNA, 20 bp, Artificial Sequence
  sgRNA
  Vasn_18
atacggcccgaggacctcgc

SEQ ID NO: 63826 - DNA, 20 bp, Artificial Sequence
  sgRNA
  Vasn_19
ggagcaccagaagcaacaac

SEQ ID NO: 63827 - DNA, 20 bp, Artificial Sequence
  sgRNA
  Vasn_20
tatagtaggtactgtggccg

SEQ ID NO: 63828 - DNA, 20 bp, Artificial Sequence
  sgRNA
  Vcam1_1
gctggaacgaagtatccacg

SEQ ID NO: 63829 - DNA, 20 bp, Artificial Sequence
  sgRNA
  Vcam1_2
agacagcccactaaacgcga

SEQ ID NO: 63830 - DNA, 20 bp, Artificial Sequence
  sgRNA
  Vcam1_3
cacagagctcaacacaagcg

SEQ ID NO: 63831 - DNA, 20 bp, Artificial Sequence
  sgRNA
  Vcam1_4
tccctccacaaggcttcaag

SEQ ID NO: 63832 - DNA, 20 bp, Artificial Sequence
  sgRNA
  Vcam1_5
tcagtaattcaatctccaga

SEQ ID NO: 63833 - DNA, 20 bp, Artificial Sequence
  sgRNA
  Vcam1_6
ggtcaatgtgtaatttagct

SEQ ID NO: 63834 - DNA, 20 bp, Artificial Sequence
  sgRNA
  Vcam1_7
ccctctcctatactagagga

SEQ ID NO: 63835 - DNA, 20 bp, Artificial Sequence
  sgRNA
  Vcam1_8
aaaataaacgatcatcccga

SEQ ID NO: 63836 - DNA, 20 bp, Artificial Sequence
  sgRNA
  Vcam1_9
ttaggtgtacagtcaattga

SEQ ID NO: 63837 - DNA, 20 bp, Artificial Sequence
  sgRNA
  Vcam1_10
gccctcctctagtataggag

SEQ ID NO: 63838 - DNA, 20 bp, Artificial Sequence
  sgRNA
  Vcam1_11
ccggcttcccaacctccagg

SEQ ID NO: 63839 - DNA, 20 bp, Artificial Sequence
  sgRNA
  Vcam1_12
acaatgacctgttccagcga

SEQ ID NO: 63840 - DNA, 20 bp, Artificial Sequence
  sgRNA
  Vcam1_13
ttccttaccaccccattgag

SEQ ID NO: 63841 - DNA, 20 bp, Artificial Sequence
  sgRNA
  Vcam1_14
ccctcaccttaattgctatg

SEQ ID NO: 63842 - DNA, 20 bp, Artificial Sequence
  sgRNA
  Vcam1_15
tccttggtaatacctgccat

SEQ ID NO: 63843 - DNA, 20 bp, Artificial Sequence
  sgRNA
  Vcam1_16
ggggagatgtcaacaataaa

SEQ ID NO: 63844 - DNA, 20 bp, Artificial Sequence
  sgRNA
  Vcam1_17
tttccaatatcctcaatgac

SEQ ID NO: 63845 - DNA, 20 bp, Artificial Sequence
  sgRNA
  Vcam1_18
gacaggctccatggtcagaa

SEQ ID NO: 63846 - DNA, 20 bp, Artificial Sequence
  sgRNA
  Vcam1_19
gtgcagccacctgagatccg

SEQ ID NO: 63847 - DNA, 20 bp, Artificial Sequence
  sgRNA
  Vcam1_20
ccctccacaaggcttcaaga

SEQ ID NO: 63848 - DNA, 20 bp, Artificial Sequence
  sgRNA
  Vipr1_1
ctttatgatccaccacagtg

SEQ ID NO: 63849 - DNA, 20 bp, Artificial Sequence
  sgRNA
  Vipr1_2
agggctcttaccgtgaatgg

SEQ ID NO: 63850 - DNA, 20 bp, Artificial Sequence
  sgRNA
  Vipr1_3
ggagacagaccactgctctg

SEQ ID NO: 63851 - DNA, 20 bp, Artificial Sequence
  sgRNA
  Vipr1_4
gtgaagaccggctacaccat

SEQ ID NO: 63852 - DNA, 20 bp, Artificial Sequence
  sgRNA
  Vipr1_5
tcattcttcccaatgtcggg

SEQ ID NO: 63853 - DNA, 20 bp, Artificial Sequence
  sgRNA
  Vipr1_6
agatagccatggcaaccagg

SEQ ID NO: 63854 - DNA, 20 bp, Artificial Sequence
  sgRNA
  Vipr1_7
gggtacatactcatcggctg

SEQ ID NO: 63855 - DNA, 20 bp, Artificial Sequence
  sgRNA
  Vipr1_8
gatatggccctcttcaacaa

SEQ ID NO: 63856 - DNA, 20 bp, Artificial Sequence
  sgRNA
  Vipr1_9
tatggccctcttcaacaacg

SEQ ID NO: 63857 - DNA, 20 bp, Artificial Sequence
  sgRNA
  Vipr1_10
acgccgttgctgcctcccca

SEQ ID NO: 63858 - DNA, 20 bp, Artificial Sequence
  sgRNA
  Vipr1_11
catatccttgatgaagacgg

SEQ ID NO: 63859 - DNA, 20 bp, Artificial Sequence
  sgRNA
  Vipr1_12
tggtctttgaactcgtcgta

SEQ ID NO: 63860 - DNA, 20 bp, Artificial Sequence
  sgRNA
  Vipr1_13
tccaaatcacaacacccgtg

SEQ ID NO: 63861 - DNA, 20 bp, Artificial Sequence
  sgRNA
  Vipr1_14
atatggccctcttcaacaac

SEQ ID NO: 63862 - DNA, 20 bp, Artificial Sequence
  sgRNA
  Vipr1_15
catagtgaactccaaacaga

SEQ ID NO: 63863 - DNA, 20 bp, Artificial Sequence
  sgRNA
  Vipr1_16
gtaactgcactgaagaaggc

SEQ ID NO: 63864 - DNA, 20 bp, Artificial Sequence
  sgRNA
  Vipr1_17
cagagctgcgacggaagtgg

SEQ ID NO: 63865 - DNA, 20 bp, Artificial Sequence
  sgRNA
  Vipr1_18
ggcagtccaggactaccacc

SEQ ID NO: 63866 - DNA, 20 bp, Artificial Sequence
  sgRNA
  Vipr1_19
ccatcatcaactcctcactg

SEQ ID NO: 63867 - DNA, 20 bp, Artificial Sequence
  sgRNA
  Vipr1_20
gctgtagccgatggtgtagc

SEQ ID NO: 63868 - DNA, 20 bp, Artificial Sequence
  sgRNA
  Vipr2_1
gcatccgaatgacccaccag

SEQ ID NO: 63869 - DNA, 20 bp, Artificial Sequence
  sgRNA
  Vipr2_2
tctgggacaacatcacatgc

SEQ ID NO: 63870 - DNA, 20 bp, Artificial Sequence
  sgRNA
  Vipr2_3
aaaactgcactagcgatgga

SEQ ID NO: 63871 - DNA, 20 bp, Artificial Sequence
  sgRNA
  Vipr2_4
gatgaaagcgacattctgga

SEQ ID NO: 63872 - DNA, 20 bp, Artificial Sequence
  sgRNA
  Vipr2_5
gtgtggctacaacgaccccg

SEQ ID NO: 63873 - DNA, 20 bp, Artificial Sequence
  sgRNA
  Vipr2_6
agtgccctacagatacaccg

SEQ ID NO: 63874 - DNA, 20 bp, Artificial Sequence
  sgRNA
  Vipr2_7
tgtagtggacgccaaacagg

SEQ ID NO: 63875 - DNA, 20 bp, Artificial Sequence
  sgRNA
  Vipr2_8
ggagccacggtgtatctgta

SEQ ID NO: 63876 - DNA, 20 bp, Artificial Sequence
  sgRNA
  Vipr2_9
ccagatttcatagatgcgtg

SEQ ID NO: 63877 - DNA, 20 bp, Artificial Sequence
  sgRNA
  Vipr2_10
ttcctggcctaccttctgat

SEQ ID NO: 63878 - DNA, 20 bp, Artificial Sequence
  sgRNA
  Vipr2_11
ggcatccgaatgacccacca

SEQ ID NO: 63879 - DNA, 20 bp, Artificial Sequence
  sgRNA
  Vipr2_12
tatgtggatgagatgccaat

SEQ ID NO: 63880 - DNA, 20 bp, Artificial Sequence
  sgRNA
  Vipr2_13
gaactgaaaagaagatggcg

SEQ ID NO: 63881 - DNA, 20 bp, Artificial Sequence
  sgRNA
  Vipr2_14
actacaatagaaattagaat

SEQ ID NO: 63882 - DNA, 20 bp, Artificial Sequence
  sgRNA
  Vipr2_15
gaggaaggatggctaccagg

SEQ ID NO: 63883 - DNA, 20 bp, Artificial Sequence
  sgRNA
  Vipr2_16
agtttgccatgatacagtac

SEQ ID NO: 63884 - DNA, 20 bp, Artificial Sequence
  sgRNA
  Vipr2_17
ggcctaccttctgatcggat

SEQ ID NO: 63885 - DNA, 20 bp, Artificial Sequence
  sgRNA
  Vipr2_18
agtatagaactgctaccacc

SEQ ID NO: 63886 - DNA, 20 bp, Artificial Sequence
  sgRNA
  Vipr2_19
tgaagtctctgactgcagga

SEQ ID NO: 63887 - DNA, 20 bp, Artificial Sequence
  sgRNA
  Vipr2_20
atactgcttcctgaacagtg

SEQ ID NO: 63888 - DNA, 20 bp, Artificial Sequence
  sgRNA
  Vldlr_1
ttgatgaatgccaaaacccg

SEQ ID NO: 63889 - DNA, 20 bp, Artificial Sequence
  sgRNA
  Vldlr_2
tagaatacaaaccccgacaa

SEQ ID NO: 63890 - DNA, 20 bp, Artificial Sequence
  sgRNA
  Vldlr_3
agtgcattcacaaaaaatgg

SEQ ID NO: 63891 - DNA, 20 bp, Artificial Sequence
  sgRNA
  Vldlr_4
agagcaactaaggaacacgg

SEQ ID NO: 63892 - DNA, 20 bp, Artificial Sequence
  sgRNA
  Vldlr_5
gtacacccaatcaacagcaa

SEQ ID NO: 63893 - DNA, 20 bp, Artificial Sequence
  sgRNA
  Vldlr_6
gaggacctgtcgatagacat

SEQ ID NO: 63894 - DNA, 20 bp, Artificial Sequence
  sgRNA
  Vldlr_7
tcatcacacacccagctgag

SEQ ID NO: 63895 - DNA, 20 bp, Artificial Sequence
  sgRNA
  Vldlr_8
gccagtgtgttcctaacaga

SEQ ID NO: 63896 - DNA, 20 bp, Artificial Sequence
  sgRNA
  Vldlr_9
tgatagacgtcctctggtga

SEQ ID NO: 63897 - DNA, 20 bp, Artificial Sequence
  sgRNA
  Vldlr_10
gctcaagagactcgtctgat

SEQ ID NO: 63898 - DNA, 20 bp, Artificial Sequence
  sgRNA
  Vldlr_11
catgaactcgtccagccgtc

SEQ ID NO: 63899 - DNA, 20 bp, Artificial Sequence
  sgRNA
  Vldlr_12
gtacttgaagaccactgaag

SEQ ID NO: 63900 - DNA, 20 bp, Artificial Sequence
  sgRNA
  Vldlr_13
atacctgttcctgtcccaat

SEQ ID NO: 63901 - DNA, 20 bp, Artificial Sequence
  sgRNA
  Vldlr_14
tcttcgagattgtacccatt

SEQ ID NO: 63902 - DNA, 20 bp, Artificial Sequence
  sgRNA
  Vldlr_15
atttgtatcaacttaaaagg

SEQ ID NO: 63903 - DNA, 20 bp, Artificial Sequence
  sgRNA
  Vldlr_16
tcagtggtcttcaagtacac

SEQ ID NO: 63904 - DNA, 20 bp, Artificial Sequence
  sgRNA
  Vldlr_17
aagtcagtgttcccccaaaa

SEQ ID NO: 63905 - DNA, 20 bp, Artificial Sequence
  sgRNA
  Vldlr_18
atgtagtcgtggctatcaaa

SEQ ID NO: 63906 - DNA, 20 bp, Artificial Sequence
  sgRNA
  Vldlr_19
agagccacactggatctcac

SEQ ID NO: 63907 - DNA, 20 bp, Artificial Sequence
  sgRNA
  Vldlr_20
cctaccagtgagatccagtg

SEQ ID NO: 63908 - DNA, 20 bp, Artificial Sequence
  sgRNA
  Vmn1r184_1
ccccacataataggactttg

SEQ ID NO: 63909 - DNA, 20 bp, Artificial Sequence
  sgRNA
  Vmn1r184_2
catgtgcaagatccacatga

SEQ ID NO: 63910 - DNA, 20 bp, Artificial Sequence
  sgRNA
  Vmn1r184_3
tatcatggagccactagacc

SEQ ID NO: 63911 - DNA, 20 bp, Artificial Sequence
  sgRNA
  Vmn1r184_4
ttattatcacaaactacagt

SEQ ID NO: 63912 - DNA, 20 bp, Artificial Sequence
  sgRNA
  Vmn1r184_5
tctatttaaacacaagcaga

SEQ ID NO: 63913 - DNA, 20 bp, Artificial Sequence
  sgRNA
  Vmn1r184_6
tcaggagtgccccacataat

SEQ ID NO: 63914 - DNA, 20 bp, Artificial Sequence
  sgRNA
  Vmn1r184_7
cctcatgtctagatgcaatt

SEQ ID NO: 63915 - DNA, 20 bp, Artificial Sequence
  sgRNA
  Vmn1r184_8
tctggcagccagattccaga

SEQ ID NO: 63916 - DNA, 20 bp, Artificial Sequence
  sgRNA
  Vmn1r184_9
ccccaaagtcctattatgtg

SEQ ID NO: 63917 - DNA, 20 bp, Artificial Sequence
  sgRNA
  Vmn1r184_10
ttctatttaaacacaagcag

SEQ ID NO: 63918 - DNA, 20 bp, Artificial Sequence
  sgRNA
  Vmn1r184_11
gcagttccatttccctcatg

SEQ ID NO: 63919 - DNA, 20 bp, Artificial Sequence
  sgRNA
  Vmn1r184_12
gcatgtgcaagatccacatg

SEQ ID NO: 63920 - DNA, 20 bp, Artificial Sequence
  sgRNA
  Vmn1r184_13
aataatgtaccctcttaaaa

SEQ ID NO: 63921 - DNA, 20 bp, Artificial Sequence
  sgRNA
  Vmn1r184_14
gtccccaaagtcctattatg

SEQ ID NO: 63922 - DNA, 20 bp, Artificial Sequence
  sgRNA
  Vmn1r184_15
ccaaattgcatctagacatg

SEQ ID NO: 63923 - DNA, 20 bp, Artificial Sequence
  sgRNA
  Vmn1r184_16
tccccaaagtcctattatgt

SEQ ID NO: 63924 - DNA, 20 bp, Artificial Sequence
  sgRNA
  Vmn1r184_17
caaattgcatctagacatga

SEQ ID NO: 63925 - DNA, 20 bp, Artificial Sequence
  sgRNA
  Vmn1r184_18
aatgtaccctcttaaaatgg

SEQ ID NO: 63926 - DNA, 20 bp, Artificial Sequence
  sgRNA
  Vmn1r184_19
gccccacataataggacttt

SEQ ID NO: 63927 - DNA, 20 bp, Artificial Sequence
  sgRNA
  Vmn1r184_20
aaaacacatggtccaaaaga

SEQ ID NO: 63928 - DNA, 20 bp, Artificial Sequence
  sgRNA
  Vmn1r185_1
ccccaaaatgctattatgtg

SEQ ID NO: 63929 - DNA, 20 bp, Artificial Sequence
  sgRNA
  Vmn1r185_2
gcatgtgcaagacccacatg

SEQ ID NO: 63930 - DNA, 20 bp, Artificial Sequence
  sgRNA
  Vmn1r185_3
tgaatttctctatgcagcat

SEQ ID NO: 63931 - DNA, 20 bp, Artificial Sequence
  sgRNA
  Vmn1r185_4
tttgaatagaatgactatca

SEQ ID NO: 63932 - DNA, 20 bp, Artificial Sequence
  sgRNA
  Vmn1r185_5
gtcaaagctataatgcacaa

SEQ ID NO: 63933 - DNA, 20 bp, Artificial Sequence
  sgRNA
  Vmn1r185_6
cctcatgtctagattcaact

SEQ ID NO: 63934 - DNA, 20 bp, Artificial Sequence
  sgRNA
  Vmn1r185_7
catgtgcaagacccacatga

SEQ ID NO: 63935 - DNA, 20 bp, Artificial Sequence
  sgRNA
  Vmn1r185_8
tgtagtaaaggactagatag

SEQ ID NO: 63936 - DNA, 20 bp, Artificial Sequence
  sgRNA
  Vmn1r185_9
ccaagttgaatctagacatg

SEQ ID NO: 63937 - DNA, 20 bp, Artificial Sequence
  sgRNA
  Vmn1r185_10
tctattcaaacacaagaaga

SEQ ID NO: 63938 - DNA, 20 bp, Artificial Sequence
  sgRNA
  Vmn1r185_11
aaaacacatggcccaaaaga

SEQ ID NO: 63939 - DNA, 20 bp, Artificial Sequence
  sgRNA
  Vmn1r185_12
ttattatcccaaactacagt

SEQ ID NO: 63940 - DNA, 20 bp, Artificial Sequence
  sgRNA
  Vmn1r185_13
aatgcaccctcttaaaatgg

SEQ ID NO: 63941 - DNA, 20 bp, Artificial Sequence
  sgRNA
  Vmn1r185_14
ccagaattccaactgtagtt

SEQ ID NO: 63942 - DNA, 20 bp, Artificial Sequence
  sgRNA
  Vmn1r185_15
caagttgaatctagacatga

SEQ ID NO: 63943 - DNA, 20 bp, Artificial Sequence
  sgRNA
  Vmn1r185_16
agcaatgcaccctcttaaaa

SEQ ID NO: 63944 - DNA, 20 bp, Artificial Sequence
  sgRNA
  Vmn1r185_17
ctgttccatttccctcatgt

SEQ ID NO: 63945 - DNA, 20 bp, Artificial Sequence
  sgRNA
  Vmn1r185_18
taacttctcatgaaaacaca

SEQ ID NO: 63946 - DNA, 20 bp, Artificial Sequence
  sgRNA
  Vmn1r185_19
gtccccaaaatgctattatg

SEQ ID NO: 63947 - DNA, 20 bp, Artificial Sequence
  sgRNA
  Vmn1r185_20
gctgttccatttccctcatg

SEQ ID NO: 63948 - DNA, 20 bp, Artificial Sequence
  sgRNA
  Vmn1r224_1
gaagagaccaatatgatttg

SEQ ID NO: 63949 - DNA, 20 bp, Artificial Sequence
  sgRNA
  Vmn1r224_2
aaaatcatcatgaactacag

SEQ ID NO: 63950 - DNA, 20 bp, Artificial Sequence
  sgRNA
  Vmn1r224_3
atagtaattgaataggtagc

SEQ ID NO: 63951 - DNA, 20 bp, Artificial Sequence
  sgRNA
  Vmn1r224_4
aaaggatttatcaatgactt

SEQ ID NO: 63952 - DNA, 20 bp, Artificial Sequence
  sgRNA
  Vmn1r224_5
tgatgaatcatgactcaact

SEQ ID NO: 63953 - DNA, 20 bp, Artificial Sequence
  sgRNA
  Vmn1r224_6
taccaaggccagtatcctgt

SEQ ID NO: 63954 - DNA, 20 bp, Artificial Sequence
  sgRNA
  Vmn1r224_7
ttgtcgttctctatatgcac

SEQ ID NO: 63955 - DNA, 20 bp, Artificial Sequence
  sgRNA
  Vmn1r224_8
agaaagaaggatcaaaaagt

SEQ ID NO: 63956 - DNA, 20 bp, Artificial Sequence
  sgRNA
  Vmn1r224_9
agcaatgtaaccttgtaaga

SEQ ID NO: 63957 - DNA, 20 bp, Artificial Sequence
  sgRNA
  Vmn1r224_10
tctttggtggattctctaca

SEQ ID NO: 63958 - DNA, 20 bp, Artificial Sequence
  sgRNA
  Vmn1r224_11
ccagtctttgaatatacaaa

SEQ ID NO: 63959 - DNA, 20 bp, Artificial Sequence
  sgRNA
  Vmn1r224_12
aggccatcaccatcagtcct

SEQ ID NO: 63960 - DNA, 20 bp, Artificial Sequence
  sgRNA
  Vmn1r224_13
tctttgttatacatataaac

SEQ ID NO: 63961 - DNA, 20 bp, Artificial Sequence
  sgRNA
  Vmn1r224_14
ttgtatataatcctggttgg

SEQ ID NO: 63962 - DNA, 20 bp, Artificial Sequence
  sgRNA
  Vmn1r224_15
ctgagtccagagctacccac

SEQ ID NO: 63963 - DNA, 20 bp, Artificial Sequence
  sgRNA
  Vmn1r224_16
atataatcctggttggtggc

SEQ ID NO: 63964 - DNA, 20 bp, Artificial Sequence
  sgRNA
  Vmn1r224_17
gagggcataaaatcctataa

SEQ ID NO: 63965 - DNA, 20 bp, Artificial Sequence
  sgRNA
  Vmn1r224_18
catctggtccagcagctcca

SEQ ID NO: 63966 - DNA, 20 bp, Artificial Sequence
  sgRNA
  Vmn1r224_19
catatagagaacgacaacca

SEQ ID NO: 63967 - DNA, 20 bp, Artificial Sequence
  sgRNA
  Vmn1r224_20
ggcataaaatcctataaagg

SEQ ID NO: 63968 - DNA, 20 bp, Artificial Sequence
  sgRNA
  Vmn1r225_1
ctttgtcacgaccttgagag

SEQ ID NO: 63969 - DNA, 20 bp, Artificial Sequence
  sgRNA
  Vmn1r225_2
accaaaagctgccattatct

SEQ ID NO: 63970 - DNA, 20 bp, Artificial Sequence
  sgRNA
  Vmn1r225_3
gaaaaaaagtatttactagc

SEQ ID NO: 63971 - DNA, 20 bp, Artificial Sequence
  sgRNA
  Vmn1r225_4
aaagacactcaagagacagg

SEQ ID NO: 63972 - DNA, 20 bp, Artificial Sequence
  sgRNA
  Vmn1r225_5
agctagaaaggtgcaaacca

SEQ ID NO: 63973 - DNA, 20 bp, Artificial Sequence
  sgRNA
  Vmn1r225_6
ctttgaatgcatccaccaaa

SEQ ID NO: 63974 - DNA, 20 bp, Artificial Sequence
  sgRNA
  Vmn1r225_7
ttatctaattctttactaca

SEQ ID NO: 63975 - DNA, 20 bp, Artificial Sequence
  sgRNA
  Vmn1r225_8
actctctcttcaatcttaca

SEQ ID NO: 63976 - DNA, 20 bp, Artificial Sequence
  sgRNA
  Vmn1r225_9
cacacagaaaatcctcaccc

SEQ ID NO: 63977 - DNA, 20 bp, Artificial Sequence
  sgRNA
  Vmn1r225_10
aaaaataagacacaaaagag

SEQ ID NO: 63978 - DNA, 20 bp, Artificial Sequence
  sgRNA
  Vmn1r225_11
tcagtcccaggaactcctac

SEQ ID NO: 63979 - DNA, 20 bp, Artificial Sequence
  sgRNA
  Vmn1r225_12
tccttccagtaggagttcct

SEQ ID NO: 63980 - DNA, 20 bp, Artificial Sequence
  sgRNA
  Vmn1r225_13
tattcattacccaccaactg

SEQ ID NO: 63981 - DNA, 20 bp, Artificial Sequence
  sgRNA
  Vmn1r225_14
ttcacataaccccagttggt

SEQ ID NO: 63982 - DNA, 20 bp, Artificial Sequence
  sgRNA
  Vmn1r225_15
gtaggagttcctgggactga

SEQ ID NO: 63983 - DNA, 20 bp, Artificial Sequence
  sgRNA
  Vmn1r225_16
gtacagaaaataagacttca

SEQ ID NO: 63984 - DNA, 20 bp, Artificial Sequence
  sgRNA
  Vmn1r225_17
gaataatgactcatcacaaa

SEQ ID NO: 63985 - DNA, 20 bp, Artificial Sequence
  sgRNA
  Vmn1r225_18
gaaaggtgcaaaccagggtg

SEQ ID NO: 63986 - DNA, 20 bp, Artificial Sequence
  sgRNA
  Vmn1r225_19
gcccagataatggcagcttt

SEQ ID NO: 63987 - DNA, 20 bp, Artificial Sequence
  sgRNA
  Vmn1r225_20
tcccaggaactcctactgga

SEQ ID NO: 63988 - DNA, 20 bp, Artificial Sequence
  sgRNA
  Vmn1r226_1
tattggtagctgtataaatg

SEQ ID NO: 63989 - DNA, 20 bp, Artificial Sequence
  sgRNA
  Vmn1r226_2
aagcaatcaccattagcccc

SEQ ID NO: 63990 - DNA, 20 bp, Artificial Sequence
  sgRNA
  Vmn1r226_3
gtttgtcacgacctatagag

SEQ ID NO: 63991 - DNA, 20 bp, Artificial Sequence
  sgRNA
  Vmn1r226_4
aagcagttattcagtgatgt

SEQ ID NO: 63992 - DNA, 20 bp, Artificial Sequence
  sgRNA
  Vmn1r226_5
aatagtgctctcacttcaga

SEQ ID NO: 63993 - DNA, 20 bp, Artificial Sequence
  sgRNA
  Vmn1r226_6
ccttcaagcaggagttcctg

SEQ ID NO: 63994 - DNA, 20 bp, Artificial Sequence
  sgRNA
  Vmn1r226_7
gcctaatgtaggaaaacaca

SEQ ID NO: 63995 - DNA, 20 bp, Artificial Sequence
  sgRNA
  Vmn1r226_8
tttgaattctgccactctat

SEQ ID NO: 63996 - DNA, 20 bp, Artificial Sequence
  sgRNA
  Vmn1r226_9
gcatatttactagaatgaaa

SEQ ID NO: 63997 - DNA, 20 bp, Artificial Sequence
  sgRNA
  Vmn1r226_10
tactttatggacataagaag

SEQ ID NO: 63998 - DNA, 20 bp, Artificial Sequence
  sgRNA
  Vmn1r226_11
ctattggtagctgtataaat

SEQ ID NO: 63999 - DNA, 20 bp, Artificial Sequence
  sgRNA
  Vmn1r226_12
ttcaaataatcccagttggt

SEQ ID NO: 64000 - DNA, 20 bp, Artificial Sequence
  sgRNA
  Vmn1r226_13
ccatttatacagctaccaat

SEQ ID NO: 64001 - DNA, 20 bp, Artificial Sequence
  sgRNA
  Vmn1r226_14
aatcaggacttatcacaata

SEQ ID NO: 64002 - DNA, 20 bp, Artificial Sequence
  sgRNA
  Vmn1r226_15
ctctttcaaataatcccagt

SEQ ID NO: 64003 - DNA, 20 bp, Artificial Sequence
  sgRNA
  Vmn1r226_16
cctgaagtagtgaaagcttt

SEQ ID NO: 64004 - DNA, 20 bp, Artificial Sequence
  sgRNA
  Vmn1r226_17
tttcaaataatcccagttgg

SEQ ID NO: 64005 - DNA, 20 bp, Artificial Sequence
  sgRNA
  Vmn1r226_18
aaagacactcaagaaacagg

SEQ ID NO: 64006 - DNA, 20 bp, Artificial Sequence
  sgRNA
  Vmn1r226_19
ggaaagaatagttaagaagt

SEQ ID NO: 64007 - DNA, 20 bp, Artificial Sequence
  sgRNA
  Vmn1r226_20
actttatggacataagaaga

SEQ ID NO: 64008 - DNA, 20 bp, Artificial Sequence
  sgRNA
  Vmn1r227_1
ctgtctacacaactaccaag

SEQ ID NO: 64009 - DNA, 20 bp, Artificial Sequence
  sgRNA
  Vmn1r227_2
tatctccatcggaatccctg

SEQ ID NO: 64010 - DNA, 20 bp, Artificial Sequence
  sgRNA
  Vmn1r227_3
gagagtacaaaatactacaa

SEQ ID NO: 64011 - DNA, 20 bp, Artificial Sequence
  sgRNA
  Vmn1r227_4
atatctccatcggaatccct

SEQ ID NO: 64012 - DNA, 20 bp, Artificial Sequence
  sgRNA
  Vmn1r227_5
gggcatttgaagcctttggg

SEQ ID NO: 64013 - DNA, 20 bp, Artificial Sequence
  sgRNA
  Vmn1r227_6
gatattcatcaaccaccgac

SEQ ID NO: 64014 - DNA, 20 bp, Artificial Sequence
  sgRNA
  Vmn1r227_7
acattaggtccatttgtgat

SEQ ID NO: 64015 - DNA, 20 bp, Artificial Sequence
  sgRNA
  Vmn1r227_8
caaaggcttcaaatgcccca

SEQ ID NO: 64016 - DNA, 20 bp, Artificial Sequence
  sgRNA
  Vmn1r227_9
gagcactattccaattgcca

SEQ ID NO: 64017 - DNA, 20 bp, Artificial Sequence
  sgRNA
  Vmn1r227_10
gcatatttactagcatcaac

SEQ ID NO: 64018 - DNA, 20 bp, Artificial Sequence
  sgRNA
  Vmn1r227_11
tgattacccaaaagacactc

SEQ ID NO: 64019 - DNA, 20 bp, Artificial Sequence
  sgRNA
  Vmn1r227_12
gaataccagattccacccaa

SEQ ID NO: 64020 - DNA, 20 bp, Artificial Sequence
  sgRNA
  Vmn1r227_13
gagggaagaatgagcatgaa

SEQ ID NO: 64021 - DNA, 20 bp, Artificial Sequence
  sgRNA
  Vmn1r227_14
cagaatggacttgagaacca

SEQ ID NO: 64022 - DNA, 20 bp, Artificial Sequence
  sgRNA
  Vmn1r227_15
tgaagatgctggaacataca

SEQ ID NO: 64023 - DNA, 20 bp, Artificial Sequence
  sgRNA
  Vmn1r227_16
tcttggtagttgtgtagaca

SEQ ID NO: 64024 - DNA, 20 bp, Artificial Sequence
  sgRNA
  Vmn1r227_17
ggtgcaaaccagaaccagga

SEQ ID NO: 64025 - DNA, 20 bp, Artificial Sequence
  sgRNA
  Vmn1r227_18
ccttccagcagtagttcctg

SEQ ID NO: 64026 - DNA, 20 bp, Artificial Sequence
  sgRNA
  Vmn1r227_19
actttacgtacacaagaaga

SEQ ID NO: 64027 - DNA, 20 bp, Artificial Sequence
  sgRNA
  Vmn1r227_20
aatctggtattcaatgattt

SEQ ID NO: 64028 - DNA, 20 bp, Artificial Sequence
  sgRNA
  Vmn1r228_1
gactttagggacatggcagt

SEQ ID NO: 64029 - DNA, 20 bp, Artificial Sequence
  sgRNA
  Vmn1r228_2
caaaagctcccattacctca

SEQ ID NO: 64030 - DNA, 20 bp, Artificial Sequence
  sgRNA
  Vmn1r228_3
tattgctagctgtatataaa

SEQ ID NO: 64031 - DNA, 20 bp, Artificial Sequence
  sgRNA
  Vmn1r228_4
aaagacacttaagaaacagg

SEQ ID NO: 64032 - DNA, 20 bp, Artificial Sequence
  sgRNA
  Vmn1r228_5
ggagagaaggatcaaggcgt

SEQ ID NO: 64033 - DNA, 20 bp, Artificial Sequence
  sgRNA
  Vmn1r228_6
tcagtcccagtaactcctgc

SEQ ID NO: 64034 - DNA, 20 bp, Artificial Sequence
  sgRNA
  Vmn1r228_7
actttacagacacaagaaaa

SEQ ID NO: 64035 - DNA, 20 bp, Artificial Sequence
  sgRNA
  Vmn1r228_8
tctgaattctgtcactctgg

SEQ ID NO: 64036 - DNA, 20 bp, Artificial Sequence
  sgRNA
  Vmn1r228_9
tatattcattacccaccaat

SEQ ID NO: 64037 - DNA, 20 bp, Artificial Sequence
  sgRNA
  Vmn1r228_10
ttcacatgatcccaattggt

SEQ ID NO: 64038 - DNA, 20 bp, Artificial Sequence
  sgRNA
  Vmn1r228_11
tctctccaaaggaccccctg

SEQ ID NO: 64039 - DNA, 20 bp, Artificial Sequence
  sgRNA
  Vmn1r228_12
agcaatatatccatgtaaaa

SEQ ID NO: 64040 - DNA, 20 bp, Artificial Sequence
  sgRNA
  Vmn1r228_13
cattacctcagggggtcctt

SEQ ID NO: 64041 - DNA, 20 bp, Artificial Sequence
  sgRNA
  Vmn1r228_14
aagcagttattcaataatgt

SEQ ID NO: 64042 - DNA, 20 bp, Artificial Sequence
  sgRNA
  Vmn1r228_15
catgtctctgagccacaaca

SEQ ID NO: 64043 - DNA, 20 bp, Artificial Sequence
  sgRNA
  Vmn1r228_16
gtaaagtatgacaatcatga

SEQ ID NO: 64044 - DNA, 20 bp, Artificial Sequence
  sgRNA
  Vmn1r228_17
gcaatagtaatagagaaaat

SEQ ID NO: 64045 - DNA, 20 bp, Artificial Sequence
  sgRNA
  Vmn1r228_18
gttaagactacaaagtttat

SEQ ID NO: 64046 - DNA, 20 bp, Artificial Sequence
  sgRNA
  Vmn1r228_19
cctgtccatttccttctact

SEQ ID NO: 64047 - DNA, 20 bp, Artificial Sequence
  sgRNA
  Vmn1r228_20
gattagatagtagaaaagaa

SEQ ID NO: 64048 - DNA, 20 bp, Artificial Sequence
  sgRNA
  Vmn1r229_1
aggcaatcaccataagcacc

SEQ ID NO: 64049 - DNA, 20 bp, Artificial Sequence
  sgRNA
  Vmn1r229_2
tgttggttgatgtatataca

SEQ ID NO: 64050 - DNA, 20 bp, Artificial Sequence
  sgRNA
  Vmn1r229_3
gagcaaacagcaaagttcat

SEQ ID NO: 64051 - DNA, 20 bp, Artificial Sequence
  sgRNA
  Vmn1r229_4
catgctaattgacatactcc

SEQ ID NO: 64052 - DNA, 20 bp, Artificial Sequence
  sgRNA
  Vmn1r229_5
ggtgcaaaccaggatcagaa

SEQ ID NO: 64053 - DNA, 20 bp, Artificial Sequence
  sgRNA
  Vmn1r229_6
ataaagtatgactatcatgg

SEQ ID NO: 64054 - DNA, 20 bp, Artificial Sequence
  sgRNA
  Vmn1r229_7
taagcaccaggaactcctgc

SEQ ID NO: 64055 - DNA, 20 bp, Artificial Sequence
  sgRNA
  Vmn1r229_8
actttatggacacaaaaaga

SEQ ID NO: 64056 - DNA, 20 bp, Artificial Sequence
  sgRNA
  Vmn1r229_9
aatgacttattcgatgatgt

SEQ ID NO: 64057 - DNA, 20 bp, Artificial Sequence
  sgRNA
  Vmn1r229_10
gcatatttactagcatgaat

SEQ ID NO: 64058 - DNA, 20 bp, Artificial Sequence
  sgRNA
  Vmn1r229_11
tactttatggacacaaaaag

SEQ ID NO: 64059 - DNA, 20 bp, Artificial Sequence
  sgRNA
  Vmn1r229_12
tttctccaaaggacttccag

SEQ ID NO: 64060 - DNA, 20 bp, Artificial Sequence
  sgRNA
  Vmn1r229_13
atacaatgagcaaagaaaac

SEQ ID NO: 64061 - DNA, 20 bp, Artificial Sequence
  sgRNA
  Vmn1r229_14
tgtatgttagaagagtttcc

SEQ ID NO: 64062 - DNA, 20 bp, Artificial Sequence
  sgRNA
  Vmn1r229_15
tccacactcatgcttcccct

SEQ ID NO: 64063 - DNA, 20 bp, Artificial Sequence
  sgRNA
  Vmn1r229_16
atcacgaccatcatttctat

SEQ ID NO: 64064 - DNA, 20 bp, Artificial Sequence
  sgRNA
  Vmn1r229_17
atcacaaatgggcctatagc

SEQ ID NO: 64065 - DNA, 20 bp, Artificial Sequence
  sgRNA
  Vmn1r229_18
agattctgctttacctgtat

SEQ ID NO: 64066 - DNA, 20 bp, Artificial Sequence
  sgRNA
  Vmn1r229_19
attgaattctgccactctgt

SEQ ID NO: 64067 - DNA, 20 bp, Artificial Sequence
  sgRNA
  Vmn1r229_20
atgacttattcgatgatgtt

SEQ ID NO: 64068 - DNA, 20 bp, Artificial Sequence
  sgRNA
  Vmn1r230_1
aatgttatggacatgtacaa

SEQ ID NO: 64069 - DNA, 20 bp, Artificial Sequence
  sgRNA
  Vmn1r230_2
atcttgatcatgctctcgaa

SEQ ID NO: 64070 - DNA, 20 bp, Artificial Sequence
  sgRNA
  Vmn1r230_3
gtttcttgggatgatagtga

SEQ ID NO: 64071 - DNA, 20 bp, Artificial Sequence
  sgRNA
  Vmn1r230_4
aaataatcaagtagtaggaa

SEQ ID NO: 64072 - DNA, 20 bp, Artificial Sequence
  sgRNA
  Vmn1r230_5
tcatcccaagaaactcctgt

SEQ ID NO: 64073 - DNA, 20 bp, Artificial Sequence
  sgRNA
  Vmn1r230_6
attgactcataagtacaaaa

SEQ ID NO: 64074 - DNA, 20 bp, Artificial Sequence
  sgRNA
  Vmn1r230_7
acatgtccataacatttact

SEQ ID NO: 64075 - DNA, 20 bp, Artificial Sequence
  sgRNA
  Vmn1r230_8
gactctaatattcttccaac

SEQ ID NO: 64076 - DNA, 20 bp, Artificial Sequence
  sgRNA
  Vmn1r230_9
ggtcctagtttccatcttta

SEQ ID NO: 64077 - DNA, 20 bp, Artificial Sequence
  sgRNA
  Vmn1r230_10
ctgaatggctctggattcag

SEQ ID NO: 64078 - DNA, 20 bp, Artificial Sequence
  sgRNA
  Vmn1r230_11
tggtctggaagacactcaag

SEQ ID NO: 64079 - DNA, 20 bp, Artificial Sequence
  sgRNA
  Vmn1r230_12
tatttcacagttcaaattgg

SEQ ID NO: 64080 - DNA, 20 bp, Artificial Sequence
  sgRNA
  Vmn1r230_13
tgcataataatcaaatctgt

SEQ ID NO: 64081 - DNA, 20 bp, Artificial Sequence
  sgRNA
  Vmn1r230_14
agtacaaaagggattgaagt

SEQ ID NO: 64082 - DNA, 20 bp, Artificial Sequence
  sgRNA
  Vmn1r230_15
taggggaagcatgagtactg

SEQ ID NO: 64083 - DNA, 20 bp, Artificial Sequence
  sgRNA
  Vmn1r230_16
tgttctctggtctcatcacc

SEQ ID NO: 64084 - DNA, 20 bp, Artificial Sequence
  sgRNA
  Vmn1r230_17
ctatcacaatgggagctttg

SEQ ID NO: 64085 - DNA, 20 bp, Artificial Sequence
  sgRNA
  Vmn1r230_18
aaaggaatgtctatcacaat

SEQ ID NO: 64086 - DNA, 20 bp, Artificial Sequence
  sgRNA
  Vmn1r230_19
tcagtcataatatggatgcc

SEQ ID NO: 64087 - DNA, 20 bp, Artificial Sequence
  sgRNA
  Vmn1r230_20
taggaccaggatgctctgaa

SEQ ID NO: 64088 - DNA, 20 bp, Artificial Sequence
  sgRNA
  Vmn1r231_1
ccattaaggcacgagtcact

SEQ ID NO: 64089 - DNA, 20 bp, Artificial Sequence
  sgRNA
  Vmn1r231_2
actcatccttcaatgttcag

SEQ ID NO: 64090 - DNA, 20 bp, Artificial Sequence
  sgRNA
  Vmn1r231_3
caactctttcagtatacata

SEQ ID NO: 64091 - DNA, 20 bp, Artificial Sequence
  sgRNA
  Vmn1r231_4
cccagcataggaaaatagaa

SEQ ID NO: 64092 - DNA, 20 bp, Artificial Sequence
  sgRNA
  Vmn1r231_5
gattcatgcgatgttctggt

SEQ ID NO: 64093 - DNA, 20 bp, Artificial Sequence
  sgRNA
  Vmn1r231_6
ccaaaaacaggacccagcat

SEQ ID NO: 64094 - DNA, 20 bp, Artificial Sequence
  sgRNA
  Vmn1r231_7
tcatatttaaccccaaaaac

SEQ ID NO: 64095 - DNA, 20 bp, Artificial Sequence
  sgRNA
  Vmn1r231_8
gttggcagaagtgtttccat

SEQ ID NO: 64096 - DNA, 20 bp, Artificial Sequence
  sgRNA
  Vmn1r231_9
ccaactctttcagtatacat

SEQ ID NO: 64097 - DNA, 20 bp, Artificial Sequence
  sgRNA
  Vmn1r231_10
gtgtcttgggtcacaataaa

SEQ ID NO: 64098 - DNA, 20 bp, Artificial Sequence
  sgRNA
  Vmn1r231_11
caagagacagatggtaccaa

SEQ ID NO: 64099 - DNA, 20 bp, Artificial Sequence
  sgRNA
  Vmn1r231_12
tgtctgttctgggagcttaa

SEQ ID NO: 64100 - DNA, 20 bp, Artificial Sequence
  sgRNA
  Vmn1r231_13
gcacgagtcactgggactga

SEQ ID NO: 64101 - DNA, 20 bp, Artificial Sequence
  sgRNA
  Vmn1r231_14
cacttaatatatacatacat

SEQ ID NO: 64102 - DNA, 20 bp, Artificial Sequence
  sgRNA
  Vmn1r231_15
tttgtataggcacaagcagc

SEQ ID NO: 64103 - DNA, 20 bp, Artificial Sequence
  sgRNA
  Vmn1r231_16
ggatagcaaacaagacttca

SEQ ID NO: 64104 - DNA, 20 bp, Artificial Sequence
  sgRNA
  Vmn1r231_17
gtgctagtgtcactctttat

SEQ ID NO: 64105 - DNA, 20 bp, Artificial Sequence
  sgRNA
  Vmn1r231_18
gaattcccactgaacattga

SEQ ID NO: 64106 - DNA, 20 bp, Artificial Sequence
  sgRNA
  Vmn1r231_19
tgattcatgcgatgttctgg

SEQ ID NO: 64107 - DNA, 20 bp, Artificial Sequence
  sgRNA
  Vmn1r231_20
gaagacactcaagagacaga

SEQ ID NO: 64108 - DNA, 20 bp, Artificial Sequence
  sgRNA
  Vmn1r232_1
tcttggtagatgtatacaca

SEQ ID NO: 64109 - DNA, 20 bp, Artificial Sequence
  sgRNA
  Vmn1r232_2
caaaagctcccattatctgg

SEQ ID NO: 64110 - DNA, 20 bp, Artificial Sequence
  sgRNA
  Vmn1r232_3
tcagccccaggaattcccat

SEQ ID NO: 64111 - DNA, 20 bp, Artificial Sequence
  sgRNA
  Vmn1r232_4
tgaatgacctaatggagtcc

SEQ ID NO: 64112 - DNA, 20 bp, Artificial Sequence
  sgRNA
  Vmn1r232_5
acttcatgtacacaaaaaga

SEQ ID NO: 64113 - DNA, 20 bp, Artificial Sequence
  sgRNA
  Vmn1r232_6
ccatgttcctggactccatt

SEQ ID NO: 64114 - DNA, 20 bp, Artificial Sequence
  sgRNA
  Vmn1r232_7
tcttccaatgggaattcctg

SEQ ID NO: 64115 - DNA, 20 bp, Artificial Sequence
  sgRNA
  Vmn1r232_8
aaaggtttcccccagataat

SEQ ID NO: 64116 - DNA, 20 bp, Artificial Sequence
  sgRNA
  Vmn1r232_9
tatatgttcaaagacttagc

SEQ ID NO: 64117 - DNA, 20 bp, Artificial Sequence
  sgRNA
  Vmn1r232_10
cattatctgggggaaacctt

SEQ ID NO: 64118 - DNA, 20 bp, Artificial Sequence
  sgRNA
  Vmn1r232_11
ttggataagtatgagtacag

SEQ ID NO: 64119 - DNA, 20 bp, Artificial Sequence
  sgRNA
  Vmn1r232_12
ccaaaagctcccattatctg

SEQ ID NO: 64120 - DNA, 20 bp, Artificial Sequence
  sgRNA
  Vmn1r232_13
tacttcatgtacacaaaaag

SEQ ID NO: 64121 - DNA, 20 bp, Artificial Sequence
  sgRNA
  Vmn1r232_14
gactttaaatttcttccaat

SEQ ID NO: 64122 - DNA, 20 bp, Artificial Sequence
  sgRNA
  Vmn1r232_15
aggaacatggcaataggagt

SEQ ID NO: 64123 - DNA, 20 bp, Artificial Sequence
  sgRNA
  Vmn1r232_16
accacagccatcatttctat

SEQ ID NO: 64124 - DNA, 20 bp, Artificial Sequence
  sgRNA
  Vmn1r232_17
cctaatggagtccaggaaca

SEQ ID NO: 64125 - DNA, 20 bp, Artificial Sequence
  sgRNA
  Vmn1r232_18
aatagttgatatactatata

SEQ ID NO: 64126 - DNA, 20 bp, Artificial Sequence
  sgRNA
  Vmn1r232_19
ggtgcaaacaagaatcaaga

SEQ ID NO: 64127 - DNA, 20 bp, Artificial Sequence
  sgRNA
  Vmn1r232_20
gtcaaatcaacaaagtttat

SEQ ID NO: 64128 - DNA, 20 bp, Artificial Sequence
  sgRNA
  Vmn1r233_1
acctctacctattctgcgaa

SEQ ID NO: 64129 - DNA, 20 bp, Artificial Sequence
  sgRNA
  Vmn1r233_2
tctgaatgtctggagtcgct

SEQ ID NO: 64130 - DNA, 20 bp, Artificial Sequence
  sgRNA
  Vmn1r233_3
atcttaacagtactgttcaa

SEQ ID NO: 64131 - DNA, 20 bp, Artificial Sequence
  sgRNA
  Vmn1r233_4
ttgacactaatgctgcatac

SEQ ID NO: 64132 - DNA, 20 bp, Artificial Sequence
  sgRNA
  Vmn1r233_5
gatgccagtgaactgtctgt

SEQ ID NO: 64133 - DNA, 20 bp, Artificial Sequence
  sgRNA
  Vmn1r233_6
ggactcatgctatatgccag

SEQ ID NO: 64134 - DNA, 20 bp, Artificial Sequence
  sgRNA
  Vmn1r233_7
caaatatgctaacgagtagg

SEQ ID NO: 64135 - DNA, 20 bp, Artificial Sequence
  sgRNA
  Vmn1r233_8
tatgtttctttacttaacaa

SEQ ID NO: 64136 - DNA, 20 bp, Artificial Sequence
  sgRNA
  Vmn1r233_9
tcatgactcatgaggagaaa

SEQ ID NO: 64137 - DNA, 20 bp, Artificial Sequence
  sgRNA
  Vmn1r233_10
tcctttcgcagaataggtag

SEQ ID NO: 64138 - DNA, 20 bp, Artificial Sequence
  sgRNA
  Vmn1r233_11
aaaggatgcaacaaatgccc

SEQ ID NO: 64139 - DNA, 20 bp, Artificial Sequence
  sgRNA
  Vmn1r233_12
ttaaaaatgcacaaatgcat

SEQ ID NO: 64140 - DNA, 20 bp, Artificial Sequence
  sgRNA
  Vmn1r233_13
ttaagtaaagaaacatatag

SEQ ID NO: 64141 - DNA, 20 bp, Artificial Sequence
  sgRNA
  Vmn1r233_14
tgatggcctggtagacactg

SEQ ID NO: 64142 - DNA, 20 bp, Artificial Sequence
  sgRNA
  Vmn1r233_15
tatgctaacgagtaggagga

SEQ ID NO: 64143 - DNA, 20 bp, Artificial Sequence
  sgRNA
  Vmn1r233_16
ccctgtataggcacaagcaa

SEQ ID NO: 64144 - DNA, 20 bp, Artificial Sequence
  sgRNA
  Vmn1r233_17
ctctcatgcataatcccagc

SEQ ID NO: 64145 - DNA, 20 bp, Artificial Sequence
  sgRNA
  Vmn1r233_18
tgttaatcttgtgcatatga

SEQ ID NO: 64146 - DNA, 20 bp, Artificial Sequence
  sgRNA
  Vmn1r233_19
agacaaatatgctaacgagt

SEQ ID NO: 64147 - DNA, 20 bp, Artificial Sequence
  sgRNA
  Vmn1r233_20
tcatggttctaaccctgtat

SEQ ID NO: 64148 - DNA, 20 bp, Artificial Sequence
  sgRNA
  Vmn1r234_1
ggtcatcactatcagcccag

SEQ ID NO: 64149 - DNA, 20 bp, Artificial Sequence
  sgRNA
  Vmn1r234_2
gcagcacacgtgattatccc

SEQ ID NO: 64150 - DNA, 20 bp, Artificial Sequence
  sgRNA
  Vmn1r234_3
aaagcactatataattgtag

SEQ ID NO: 64151 - DNA, 20 bp, Artificial Sequence
  sgRNA
  Vmn1r234_4
actttcctaccttcataggg

SEQ ID NO: 64152 - DNA, 20 bp, Artificial Sequence
  sgRNA
  Vmn1r234_5
cttgtggaacacctttacat

SEQ ID NO: 64153 - DNA, 20 bp, Artificial Sequence
  sgRNA
  Vmn1r234_6
gagtgtatagaaacatacaa

SEQ ID NO: 64154 - DNA, 20 bp, Artificial Sequence
  sgRNA
  Vmn1r234_7
actactttcctaccttcata

SEQ ID NO: 64155 - DNA, 20 bp, Artificial Sequence
  sgRNA
  Vmn1r234_8
tcttcccaccctatgaaggt

SEQ ID NO: 64156 - DNA, 20 bp, Artificial Sequence
  sgRNA
  Vmn1r234_9
catgtctcatgagcaagtag

SEQ ID NO: 64157 - DNA, 20 bp, Artificial Sequence
  sgRNA
  Vmn1r234_10
gtgggaagaggcgtgtcatt

SEQ ID NO: 64158 - DNA, 20 bp, Artificial Sequence
  sgRNA
  Vmn1r234_11
ctttcctaccttcatagggt

SEQ ID NO: 64159 - DNA, 20 bp, Artificial Sequence
  sgRNA
  Vmn1r234_12
tgttgctctggactcatggc

SEQ ID NO: 64160 - DNA, 20 bp, Artificial Sequence
  sgRNA
  Vmn1r234_13
agtttacccaagcaaagcaa

SEQ ID NO: 64161 - DNA, 20 bp, Artificial Sequence
  sgRNA
  Vmn1r234_14
tagaatccaagtcaagtata

SEQ ID NO: 64162 - DNA, 20 bp, Artificial Sequence
  sgRNA
  Vmn1r234_15
acctcctcatgcagaatcct

SEQ ID NO: 64163 - DNA, 20 bp, Artificial Sequence
  sgRNA
  Vmn1r234_16
tcagcccagaggatgccatt

SEQ ID NO: 64164 - DNA, 20 bp, Artificial Sequence
  sgRNA
  Vmn1r234_17
ttgtccaaatggcatcctct

SEQ ID NO: 64165 - DNA, 20 bp, Artificial Sequence
  sgRNA
  Vmn1r234_18
agggaagagctgatgcactt

SEQ ID NO: 64166 - DNA, 20 bp, Artificial Sequence
  sgRNA
  Vmn1r234_19
taaaggtgttccacaagcaa

SEQ ID NO: 64167 - DNA, 20 bp, Artificial Sequence
  sgRNA
  Vmn1r234_20
cctgtgcaaaatgagaacca

SEQ ID NO: 64168 - DNA, 20 bp, Artificial Sequence
  sgRNA
  Vmn1r235_1
agagattataagtactcatg

SEQ ID NO: 64169 - DNA, 20 bp, Artificial Sequence
  sgRNA
  Vmn1r235_2
agatacacaacatcagggag

SEQ ID NO: 64170 - DNA, 20 bp, Artificial Sequence
  sgRNA
  Vmn1r235_3
ataattcaacatccagtctg

SEQ ID NO: 64171 - DNA, 20 bp, Artificial Sequence
  sgRNA
  Vmn1r235_4
gattgcacccaaaatcactt

SEQ ID NO: 64172 - DNA, 20 bp, Artificial Sequence
  sgRNA
  Vmn1r235_5
gtcatcccatcatttcctga

SEQ ID NO: 64173 - DNA, 20 bp, Artificial Sequence
  sgRNA
  Vmn1r235_6
tttaagcccaaaagctgcca

SEQ ID NO: 64174 - DNA, 20 bp, Artificial Sequence
  sgRNA
  Vmn1r235_7
ggataagaagattataccta

SEQ ID NO: 64175 - DNA, 20 bp, Artificial Sequence
  sgRNA
  Vmn1r235_8
aggccatcacaatcagcaac

SEQ ID NO: 64176 - DNA, 20 bp, Artificial Sequence
  sgRNA
  Vmn1r235_9
gctgaacctgagaatcatgg

SEQ ID NO: 64177 - DNA, 20 bp, Artificial Sequence
  sgRNA
  Vmn1r235_10
acattcttcacaatcatcca

SEQ ID NO: 64178 - DNA, 20 bp, Artificial Sequence
  sgRNA
  Vmn1r235_11
acaagctgaactccacagac

SEQ ID NO: 64179 - DNA, 20 bp, Artificial Sequence
  sgRNA
  Vmn1r235_12
gggataagaagattatacct

SEQ ID NO: 64180 - DNA, 20 bp, Artificial Sequence
  sgRNA
  Vmn1r235_13
gtataattgtcatatttctg

SEQ ID NO: 64181 - DNA, 20 bp, Artificial Sequence
  sgRNA
  Vmn1r235_14
tacattcacaaaatgggcag

SEQ ID NO: 64182 - DNA, 20 bp, Artificial Sequence
  sgRNA
  Vmn1r235_15
gattctcaggttcagccatc

SEQ ID NO: 64183 - DNA, 20 bp, Artificial Sequence
  sgRNA
  Vmn1r235_16
ttacattcacaaaatgggca

SEQ ID NO: 64184 - DNA, 20 bp, Artificial Sequence
  sgRNA
  Vmn1r235_17
tagtggttcatgagcagaaa

SEQ ID NO: 64185 - DNA, 20 bp, Artificial Sequence
  sgRNA
  Vmn1r235_18
cagaaacagttgaaagaggc

SEQ ID NO: 64186 - DNA, 20 bp, Artificial Sequence
  sgRNA
  Vmn1r235_19
acaatcatccacggagtcca

SEQ ID NO: 64187 - DNA, 20 bp, Artificial Sequence
  sgRNA
  Vmn1r235_20
tgaacctgagaatcatggag

SEQ ID NO: 64188 - DNA, 20 bp, Artificial Sequence
  sgRNA
  Vmn1r236_1
tattcctatagacaactcac

SEQ ID NO: 64189 - DNA, 20 bp, Artificial Sequence
  sgRNA
  Vmn1r236_2
tgtggcataaaggatatcac

SEQ ID NO: 64190 - DNA, 20 bp, Artificial Sequence
  sgRNA
  Vmn1r236_3
ccaaatgaggatattgtctg

SEQ ID NO: 64191 - DNA, 20 bp, Artificial Sequence
  sgRNA
  Vmn1r236_4
acaagttaaggtctacagac

SEQ ID NO: 64192 - DNA, 20 bp, Artificial Sequence
  sgRNA
  Vmn1r236_5
tcttggctcatgagaagaaa

SEQ ID NO: 64193 - DNA, 20 bp, Artificial Sequence
  sgRNA
  Vmn1r236_6
ttgttctgtgtatctcaact

SEQ ID NO: 64194 - DNA, 20 bp, Artificial Sequence
  sgRNA
  Vmn1r236_7
gtttcttctttacacagagt

SEQ ID NO: 64195 - DNA, 20 bp, Artificial Sequence
  sgRNA
  Vmn1r236_8
tctttacacagagtaggaag

SEQ ID NO: 64196 - DNA, 20 bp, Artificial Sequence
  sgRNA
  Vmn1r236_9
ctttatgccacattactgtc

SEQ ID NO: 64197 - DNA, 20 bp, Artificial Sequence
  sgRNA
  Vmn1r236_10
gaagccagtgagttgtctat

SEQ ID NO: 64198 - DNA, 20 bp, Artificial Sequence
  sgRNA
  Vmn1r236_11
aggccatcatcatcagcccc

SEQ ID NO: 64199 - DNA, 20 bp, Artificial Sequence
  sgRNA
  Vmn1r236_12
catcagccccaggaactcca

SEQ ID NO: 64200 - DNA, 20 bp, Artificial Sequence
  sgRNA
  Vmn1r236_13
cagttcttgttctcaaactg

SEQ ID NO: 64201 - DNA, 20 bp, Artificial Sequence
  sgRNA
  Vmn1r236_14
cgtgaatcttgtgcatatga

SEQ ID NO: 64202 - DNA, 20 bp, Artificial Sequence
  sgRNA
  Vmn1r236_15
tgactataattggaattcta

SEQ ID NO: 64203 - DNA, 20 bp, Artificial Sequence
  sgRNA
  Vmn1r236_16
agtacagaccaagagaagga

SEQ ID NO: 64204 - DNA, 20 bp, Artificial Sequence
  sgRNA
  Vmn1r236_17
tttagtggctctggactcag

SEQ ID NO: 64205 - DNA, 20 bp, Artificial Sequence
  sgRNA
  Vmn1r236_18
gagaagaaagggacaaacag

SEQ ID NO: 64206 - DNA, 20 bp, Artificial Sequence
  sgRNA
  Vmn1r236_19
ttataatcccaaatggtctc

SEQ ID NO: 64207 - DNA, 20 bp, Artificial Sequence
  sgRNA
  Vmn1r236_20
gtaggaaggggtacaggtat

SEQ ID NO: 64208 - DNA, 20 bp, Artificial Sequence
  sgRNA
  Vmn1r237_1
ttctactgttcatcataaca

SEQ ID NO: 64209 - DNA, 20 bp, Artificial Sequence
  sgRNA
  Vmn1r237_2
caaaggcagacacagtatgg

SEQ ID NO: 64210 - DNA, 20 bp, Artificial Sequence
  sgRNA
  Vmn1r237_3
ggcccaactcatgtacacac

SEQ ID NO: 64211 - DNA, 20 bp, Artificial Sequence
  sgRNA
  Vmn1r237_4
atctgatgctttactacatg

SEQ ID NO: 64212 - DNA, 20 bp, Artificial Sequence
  sgRNA
  Vmn1r237_5
taggaacattacacgcctaa

SEQ ID NO: 64213 - DNA, 20 bp, Artificial Sequence
  sgRNA
  Vmn1r237_6
tcagtccaagtgcttccagg

SEQ ID NO: 64214 - DNA, 20 bp, Artificial Sequence
  sgRNA
  Vmn1r237_7
agaggatgaagcacattcat

SEQ ID NO: 64215 - DNA, 20 bp, Artificial Sequence
  sgRNA
  Vmn1r237_8
gtttacaaccaatgtcatcg

SEQ ID NO: 64216 - DNA, 20 bp, Artificial Sequence
  sgRNA
  Vmn1r237_9
ttctttacagacataagcag

SEQ ID NO: 64217 - DNA, 20 bp, Artificial Sequence
  sgRNA
  Vmn1r237_10
ccataacccaacctcattat

SEQ ID NO: 64218 - DNA, 20 bp, Artificial Sequence
  sgRNA
  Vmn1r237_11
ccaaaggcagacacagtatg

SEQ ID NO: 64219 - DNA, 20 bp, Artificial Sequence
  sgRNA
  Vmn1r237_12
tgtcttgctctcatgtccat

SEQ ID NO: 64220 - DNA, 20 bp, Artificial Sequence
  sgRNA
  Vmn1r237_13
tgttcacccataatgaggtt

SEQ ID NO: 64221 - DNA, 20 bp, Artificial Sequence
  sgRNA
  Vmn1r237_14
ggtttggtccagtggctaca

SEQ ID NO: 64222 - DNA, 20 bp, Artificial Sequence
  sgRNA
  Vmn1r237_15
ataggaacattacacgccta

SEQ ID NO: 64223 - DNA, 20 bp, Artificial Sequence
  sgRNA
  Vmn1r237_16
ggtgctcaccaagagcagaa

SEQ ID NO: 64224 - DNA, 20 bp, Artificial Sequence
  sgRNA
  Vmn1r237_17
tctatcttcacagaataggg

SEQ ID NO: 64225 - DNA, 20 bp, Artificial Sequence
  sgRNA
  Vmn1r237_18
ctatcttcacagaataggga

SEQ ID NO: 64226 - DNA, 20 bp, Artificial Sequence
  sgRNA
  Vmn1r237_19
tgtggctctaaactcagcag

SEQ ID NO: 64227 - DNA, 20 bp, Artificial Sequence
  sgRNA
  Vmn1r237_20
tcttatcacagactgtagtt

SEQ ID NO: 64228 - DNA, 20 bp, Artificial Sequence
  sgRNA
  Vmn1r66_1
tacaggagtgccctacacaa

SEQ ID NO: 64229 - DNA, 20 bp, Artificial Sequence
  sgRNA
  Vmn1r66_2
tgtacattcaaagacttggt

SEQ ID NO: 64230 - DNA, 20 bp, Artificial Sequence
  sgRNA
  Vmn1r66_3
ttgattctcatgcacctctg

SEQ ID NO: 64231 - DNA, 20 bp, Artificial Sequence
  sgRNA
  Vmn1r66_4
aatttcaaaatggttaacat

SEQ ID NO: 64232 - DNA, 20 bp, Artificial Sequence
  sgRNA
  Vmn1r66_5
tcaaggcattggctccccag

SEQ ID NO: 64233 - DNA, 20 bp, Artificial Sequence
  sgRNA
  Vmn1r66_6
gaagacactcaaaaaacagg

SEQ ID NO: 64234 - DNA, 20 bp, Artificial Sequence
  sgRNA
  Vmn1r66_7
tcaacacatccacagctctc

SEQ ID NO: 64235 - DNA, 20 bp, Artificial Sequence
  sgRNA
  Vmn1r66_8
gccttgatagttctttctac

SEQ ID NO: 64236 - DNA, 20 bp, Artificial Sequence
  sgRNA
  Vmn1r66_9
agccagaaagaaaaacacta

SEQ ID NO: 64237 - DNA, 20 bp, Artificial Sequence
  sgRNA
  Vmn1r66_10
acaagattctctgtgactga

SEQ ID NO: 64238 - DNA, 20 bp, Artificial Sequence
  sgRNA
  Vmn1r66_11
ggaatagcaaaaacatgaca

SEQ ID NO: 64239 - DNA, 20 bp, Artificial Sequence
  sgRNA
  Vmn1r66_12
ctctcgtgcataatccaagt

SEQ ID NO: 64240 - DNA, 20 bp, Artificial Sequence
  sgRNA
  Vmn1r66_13
aatgtaacctcgtaagatgg

SEQ ID NO: 64241 - DNA, 20 bp, Artificial Sequence
  sgRNA
  Vmn1r66_14
agaacaaaaggtccaaaaga

SEQ ID NO: 64242 - DNA, 20 bp, Artificial Sequence
  sgRNA
  Vmn1r66_15
tgttaggccaagactaagtt

SEQ ID NO: 64243 - DNA, 20 bp, Artificial Sequence
  sgRNA
  Vmn1r66_16
actctctcctccatcttacg

SEQ ID NO: 64244 - DNA, 20 bp, Artificial Sequence
  sgRNA
  Vmn1r66_17
accatcaccagacaccaact

SEQ ID NO: 64245 - DNA, 20 bp, Artificial Sequence
  sgRNA
  Vmn1r66_18
ttctggaaacctgagagctg

SEQ ID NO: 64246 - DNA, 20 bp, Artificial Sequence
  sgRNA
  Vmn1r66_19
ctggatggctctggattcgg

SEQ ID NO: 64247 - DNA, 20 bp, Artificial Sequence
  sgRNA
  Vmn1r66_20
ctgagtgattaatttcaaaa

SEQ ID NO: 64248 - DNA, 20 bp, Artificial Sequence
  sgRNA
  Vmn1r67_1
tgagtactgttcaattagag

SEQ ID NO: 64249 - DNA, 20 bp, Artificial Sequence
  sgRNA
  Vmn1r67_2
ttgtactaacggacacactc

SEQ ID NO: 64250 - DNA, 20 bp, Artificial Sequence
  sgRNA
  Vmn1r67_3
tgaatgctgcaaagtacatt

SEQ ID NO: 64251 - DNA, 20 bp, Artificial Sequence
  sgRNA
  Vmn1r67_4
tcaaaagctgccaatgtgtg

SEQ ID NO: 64252 - DNA, 20 bp, Artificial Sequence
  sgRNA
  Vmn1r67_5
gagtactgttcaattagagg

SEQ ID NO: 64253 - DNA, 20 bp, Artificial Sequence
  sgRNA
  Vmn1r67_6
caatgattcataagaacgaa

SEQ ID NO: 64254 - DNA, 20 bp, Artificial Sequence
  sgRNA
  Vmn1r67_7
tcaaggcattggatgccatt

SEQ ID NO: 64255 - DNA, 20 bp, Artificial Sequence
  sgRNA
  Vmn1r67_8
aatgcagccttgtaaaacag

SEQ ID NO: 64256 - DNA, 20 bp, Artificial Sequence
  sgRNA
  Vmn1r67_9
gcataatcacaattggtggc

SEQ ID NO: 64257 - DNA, 20 bp, Artificial Sequence
  sgRNA
  Vmn1r67_10
tgtacattcaaagtgttggc

SEQ ID NO: 64258 - DNA, 20 bp, Artificial Sequence
  sgRNA
  Vmn1r67_11
tttgattctcatgcacctaa

SEQ ID NO: 64259 - DNA, 20 bp, Artificial Sequence
  sgRNA
  Vmn1r67_12
ttgagtactgttcaattaga

SEQ ID NO: 64260 - DNA, 20 bp, Artificial Sequence
  sgRNA
  Vmn1r67_13
caggactaggatcttctgag

SEQ ID NO: 64261 - DNA, 20 bp, Artificial Sequence
  sgRNA
  Vmn1r67_14
agaacgaagggtccaaagga

SEQ ID NO: 64262 - DNA, 20 bp, Artificial Sequence
  sgRNA
  Vmn1r67_15
gatggtataaaatgccagga

SEQ ID NO: 64263 - DNA, 20 bp, Artificial Sequence
  sgRNA
  Vmn1r67_16
tatttacagcagaatctcac

SEQ ID NO: 64264 - DNA, 20 bp, Artificial Sequence
  sgRNA
  Vmn1r67_17
ttcttatcacaaattacaag

SEQ ID NO: 64265 - DNA, 20 bp, Artificial Sequence
  sgRNA
  Vmn1r67_18
ggaaggtacacaccaggact

SEQ ID NO: 64266 - DNA, 20 bp, Artificial Sequence
  sgRNA
  Vmn1r67_19
cataagaacgaagggtccaa

SEQ ID NO: 64267 - DNA, 20 bp, Artificial Sequence
  sgRNA
  Vmn1r67_20
gtgaatgctgcaaagtacat

SEQ ID NO: 64268 - DNA, 20 bp, Artificial Sequence
  sgRNA
  Vmn1r68_1
gttggccgaagtacatccat

SEQ ID NO: 64269 - DNA, 20 bp, Artificial Sequence
  sgRNA
  Vmn1r68_2
ggccattacaatcagtcata

SEQ ID NO: 64270 - DNA, 20 bp, Artificial Sequence
  sgRNA
  Vmn1r68_3
catgtgcaagacccagagaa

SEQ ID NO: 64271 - DNA, 20 bp, Artificial Sequence
  sgRNA
  Vmn1r68_4
tggagtagtacttaaaatca

SEQ ID NO: 64272 - DNA, 20 bp, Artificial Sequence
  sgRNA
  Vmn1r68_5
gtaatgactcattagaacac

SEQ ID NO: 64273 - DNA, 20 bp, Artificial Sequence
  sgRNA
  Vmn1r68_6
gatgttcacgagccaccaat

SEQ ID NO: 64274 - DNA, 20 bp, Artificial Sequence
  sgRNA
  Vmn1r68_7
ccagaaatccatcttcgact

SEQ ID NO: 64275 - DNA, 20 bp, Artificial Sequence
  sgRNA
  Vmn1r68_8
aagccagaaatgtagacacg

SEQ ID NO: 64276 - DNA, 20 bp, Artificial Sequence
  sgRNA
  Vmn1r68_9
tatgactgattgtaatggcc

SEQ ID NO: 64277 - DNA, 20 bp, Artificial Sequence
  sgRNA
  Vmn1r68_10
tcaaggcattcgatgtcatt

SEQ ID NO: 64278 - DNA, 20 bp, Artificial Sequence
  sgRNA
  Vmn1r68_11
catagggtatcttgttataa

SEQ ID NO: 64279 - DNA, 20 bp, Artificial Sequence
  sgRNA
  Vmn1r68_12
ttctgaataatcccaattgg

SEQ ID NO: 64280 - DNA, 20 bp, Artificial Sequence
  sgRNA
  Vmn1r68_13
aggccattacaatcagtcat

SEQ ID NO: 64281 - DNA, 20 bp, Artificial Sequence
  sgRNA
  Vmn1r68_14
caagagacagatagtgccaa

SEQ ID NO: 64282 - DNA, 20 bp, Artificial Sequence
  sgRNA
  Vmn1r68_15
gcacagaagagaagatttca

SEQ ID NO: 64283 - DNA, 20 bp, Artificial Sequence
  sgRNA
  Vmn1r68_16
aatgacatcgaatgccttga

SEQ ID NO: 64284 - DNA, 20 bp, Artificial Sequence
  sgRNA
  Vmn1r68_17
gtgctcatcacctgttccag

SEQ ID NO: 64285 - DNA, 20 bp, Artificial Sequence
  sgRNA
  Vmn1r68_18
gcacacttattaaatgattt

SEQ ID NO: 64286 - DNA, 20 bp, Artificial Sequence
  sgRNA
  Vmn1r68_19
taatgactcattagaacaca

SEQ ID NO: 64287 - DNA, 20 bp, Artificial Sequence
  sgRNA
  Vmn1r68_20
aatcatggagccactggaac

SEQ ID NO: 64288 - DNA, 20 bp, Artificial Sequence
  sgRNA
  Vmn1r69_1
tactgccaatggatatactc

SEQ ID NO: 64289 - DNA, 20 bp, Artificial Sequence
  sgRNA
  Vmn1r69_2
tcaaggcattcgatgtcact

SEQ ID NO: 64290 - DNA, 20 bp, Artificial Sequence
  sgRNA
  Vmn1r69_3
ggctatcatcatcagtcaca

SEQ ID NO: 64291 - DNA, 20 bp, Artificial Sequence
  sgRNA
  Vmn1r69_4
tgaaatttataaaaatgtgc

SEQ ID NO: 64292 - DNA, 20 bp, Artificial Sequence
  sgRNA
  Vmn1r69_5
gtgctcatcacctattccag

SEQ ID NO: 64293 - DNA, 20 bp, Artificial Sequence
  sgRNA
  Vmn1r69_6
tgtacattcaaagagttggc

SEQ ID NO: 64294 - DNA, 20 bp, Artificial Sequence
  sgRNA
  Vmn1r69_7
gtaatggctcatcaaaacaa

SEQ ID NO: 64295 - DNA, 20 bp, Artificial Sequence
  sgRNA
  Vmn1r69_8
gtttgggcataaaagagtaa

SEQ ID NO: 64296 - DNA, 20 bp, Artificial Sequence
  sgRNA
  Vmn1r69_9
taatggctcatcaaaacaaa

SEQ ID NO: 64297 - DNA, 20 bp, Artificial Sequence
  sgRNA
  Vmn1r69_10
aacccagaaatgtagacacg

SEQ ID NO: 64298 - DNA, 20 bp, Artificial Sequence
  sgRNA
  Vmn1r69_11
gttggccggagtatatccat

SEQ ID NO: 64299 - DNA, 20 bp, Artificial Sequence
  sgRNA
  Vmn1r69_12
gaatcaagcccaatcgaaga

SEQ ID NO: 64300 - DNA, 20 bp, Artificial Sequence
  sgRNA
  Vmn1r69_13
gcacagaagataagatttca

SEQ ID NO: 64301 - DNA, 20 bp, Artificial Sequence
  sgRNA
  Vmn1r69_14
gtcaaatctgcaaagtacgt

SEQ ID NO: 64302 - DNA, 20 bp, Artificial Sequence
  sgRNA
  Vmn1r69_15
tacaggagtgcctcacacaa

SEQ ID NO: 64303 - DNA, 20 bp, Artificial Sequence
  sgRNA
  Vmn1r69_16
caagagacaggtactgccaa

SEQ ID NO: 64304 - DNA, 20 bp, Artificial Sequence
  sgRNA
  Vmn1r69_17
aatgtgcaggacccagagaa

SEQ ID NO: 64305 - DNA, 20 bp, Artificial Sequence
  sgRNA
  Vmn1r69_18
ttcagaataatcccaattgg

SEQ ID NO: 64306 - DNA, 20 bp, Artificial Sequence
  sgRNA
  Vmn1r69_19
ccggaaatccatcttcgatt

SEQ ID NO: 64307 - DNA, 20 bp, Artificial Sequence
  sgRNA
  Vmn1r69_20
atccaggtcaaactgagttt

SEQ ID NO: 64308 - DNA, 20 bp, Artificial Sequence
  sgRNA
  Vmn1r71_1
acacgtgcaagacccagagt

SEQ ID NO: 64309 - DNA, 20 bp, Artificial Sequence
  sgRNA
  Vmn1r71_2
ctggtgatacttctctctat

SEQ ID NO: 64310 - DNA, 20 bp, Artificial Sequence
  sgRNA
  Vmn1r71_3
gaaataacacaaatgtgaca

SEQ ID NO: 64311 - DNA, 20 bp, Artificial Sequence
  sgRNA
  Vmn1r71_4
tgactcactctatgcagctt

SEQ ID NO: 64312 - DNA, 20 bp, Artificial Sequence
  sgRNA
  Vmn1r71_5
tctctcaccaccatcttaag

SEQ ID NO: 64313 - DNA, 20 bp, Artificial Sequence
  sgRNA
  Vmn1r71_6
cactcaaaacatcctcacag

SEQ ID NO: 64314 - DNA, 20 bp, Artificial Sequence
  sgRNA
  Vmn1r71_7
cacgtgcaagacccagagta

SEQ ID NO: 64315 - DNA, 20 bp, Artificial Sequence
  sgRNA
  Vmn1r71_8
gccaatgtacttggctgcgt

SEQ ID NO: 64316 - DNA, 20 bp, Artificial Sequence
  sgRNA
  Vmn1r71_9
gaaaagtagacaccactgtg

SEQ ID NO: 64317 - DNA, 20 bp, Artificial Sequence
  sgRNA
  Vmn1r71_10
cattgtatctagactcagtt

SEQ ID NO: 64318 - DNA, 20 bp, Artificial Sequence
  sgRNA
  Vmn1r71_11
tataggtgtgccccaaaaaa

SEQ ID NO: 64319 - DNA, 20 bp, Artificial Sequence
  sgRNA
  Vmn1r71_12
tccaacgcagccaagtacat

SEQ ID NO: 64320 - DNA, 20 bp, Artificial Sequence
  sgRNA
  Vmn1r71_13
tcagccaccaactgtgacca

SEQ ID NO: 64321 - DNA, 20 bp, Artificial Sequence
  sgRNA
  Vmn1r71_14
gactggaaccatgagtgcta

SEQ ID NO: 64322 - DNA, 20 bp, Artificial Sequence
  sgRNA
  Vmn1r71_15
taatgactcataagaacaaa

SEQ ID NO: 64323 - DNA, 20 bp, Artificial Sequence
  sgRNA
  Vmn1r71_16
gatggtggtgagagaacaaa

SEQ ID NO: 64324 - DNA, 20 bp, Artificial Sequence
  sgRNA
  Vmn1r71_17
ggactctggggaatatcgac

SEQ ID NO: 64325 - DNA, 20 bp, Artificial Sequence
  sgRNA
  Vmn1r71_18
gcagttgtacttccctactc

SEQ ID NO: 64326 - DNA, 20 bp, Artificial Sequence
  sgRNA
  Vmn1r71_19
gtaatgactcataagaacaa

SEQ ID NO: 64327 - DNA, 20 bp, Artificial Sequence
  sgRNA
  Vmn1r71_20
ttcttattacaaactgtgat

SEQ ID NO: 64328 - DNA, 20 bp, Artificial Sequence
  sgRNA
  Vnn1_1
catgctcgtaaacagccgcg

SEQ ID NO: 64329 - DNA, 20 bp, Artificial Sequence
  sgRNA
  Vnn1_2
ctatgcacccgattctccaa

SEQ ID NO: 64330 - DNA, 20 bp, Artificial Sequence
  sgRNA
  Vnn1_3
taccagatttggctctaccc

SEQ ID NO: 64331 - DNA, 20 bp, Artificial Sequence
  sgRNA
  Vnn1_4
aggaaggacgtccatccagg

SEQ ID NO: 64332 - DNA, 20 bp, Artificial Sequence
  sgRNA
  Vnn1_5
ttcgctggatactttcctcg

SEQ ID NO: 64333 - DNA, 20 bp, Artificial Sequence
  sgRNA
  Vnn1_6
atacggtgtgcgtttcacca

SEQ ID NO: 64334 - DNA, 20 bp, Artificial Sequence
  sgRNA
  Vnn1_7
gtatgggtagatcgtatccc

SEQ ID NO: 64335 - DNA, 20 bp, Artificial Sequence
  sgRNA
  Vnn1_8
tacgatctacccatacctgg

SEQ ID NO: 64336 - DNA, 20 bp, Artificial Sequence
  sgRNA
  Vnn1_9
atacgatcgctccttccaga

SEQ ID NO: 64337 - DNA, 20 bp, Artificial Sequence
  sgRNA
  Vnn1_10
tttgaaatgttctcgctcag

SEQ ID NO: 64338 - DNA, 20 bp, Artificial Sequence
  sgRNA
  Vnn1_11
gcataggaagtccagttcac

SEQ ID NO: 64339 - DNA, 20 bp, Artificial Sequence
  sgRNA
  Vnn1_12
ggaacagtatggtgtccacc

SEQ ID NO: 64340 - DNA, 20 bp, Artificial Sequence
  sgRNA
  Vnn1_13
gatggttaacacaggtcccg

SEQ ID NO: 64341 - DNA, 20 bp, Artificial Sequence
  sgRNA
  Vnn1_14
ttacctttgtggagctcaaa

SEQ ID NO: 64342 - DNA, 20 bp, Artificial Sequence
  sgRNA
  Vnn1_15
aagacgccaaactttccaaa

SEQ ID NO: 64343 - DNA, 20 bp, Artificial Sequence
  sgRNA
  Vnn1_16
tatgaagtctgaggaagcat

SEQ ID NO: 64344 - DNA, 20 bp, Artificial Sequence
  sgRNA
  Vnn1_17
tcgggacctgtgttaaccat

SEQ ID NO: 64345 - DNA, 20 bp, Artificial Sequence
  sgRNA
  Vnn1_18
caacctcccaaagagcccga

SEQ ID NO: 64346 - DNA, 20 bp, Artificial Sequence
  sgRNA
  Vnn1_19
aagagcccgatggttaacac

SEQ ID NO: 64347 - DNA, 20 bp, Artificial Sequence
  sgRNA
  Vnn1_20
taaccatcgggctctttggg

SEQ ID NO: 64348 - DNA, 20 bp, Artificial Sequence
  sgRNA
  Vnn3_1
gtgttctcttacccacggcg

SEQ ID NO: 64349 - DNA, 20 bp, Artificial Sequence
  sgRNA
  Vnn3_2
gaccatttacccctacctag

SEQ ID NO: 64350 - DNA, 20 bp, Artificial Sequence
  sgRNA
  Vnn3_3
ttaccaatataataccaatg

SEQ ID NO: 64351 - DNA, 20 bp, Artificial Sequence
  sgRNA
  Vnn3_4
gatgccaaacttcccaaacg

SEQ ID NO: 64352 - DNA, 20 bp, Artificial Sequence
  sgRNA
  Vnn3_5
ctatggttggatcttcacca

SEQ ID NO: 64353 - DNA, 20 bp, Artificial Sequence
  sgRNA
  Vnn3_6
atattggtaacggccatccg

SEQ ID NO: 64354 - DNA, 20 bp, Artificial Sequence
  sgRNA
  Vnn3_7
ccaggtccctgccctaagcg

SEQ ID NO: 64355 - DNA, 20 bp, Artificial Sequence
  sgRNA
  Vnn3_8
gatcctcattgtcccccgga

SEQ ID NO: 64356 - DNA, 20 bp, Artificial Sequence
  sgRNA
  Vnn3_9
tattggtaacggccatccgg

SEQ ID NO: 64357 - DNA, 20 bp, Artificial Sequence
  sgRNA
  Vnn3_10
ccgagtgtaccactatgaca

SEQ ID NO: 64358 - DNA, 20 bp, Artificial Sequence
  sgRNA
  Vnn3_11
caagatgtctgagagccgaa

SEQ ID NO: 64359 - DNA, 20 bp, Artificial Sequence
  sgRNA
  Vnn3_12
ttaactggagcgcttatgcc

SEQ ID NO: 64360 - DNA, 20 bp, Artificial Sequence
  sgRNA
  Vnn3_13
ttcagcagttccattccatt

SEQ ID NO: 64361 - DNA, 20 bp, Artificial Sequence
  sgRNA
  Vnn3_14
gagaacttgtggggaacccg

SEQ ID NO: 64362 - DNA, 20 bp, Artificial Sequence
  sgRNA
  Vnn3_15
aatgtggtcttcgattctaa

SEQ ID NO: 64363 - DNA, 20 bp, Artificial Sequence
  sgRNA
  Vnn3_16
gaacatacacctcgtccatt

SEQ ID NO: 64364 - DNA, 20 bp, Artificial Sequence
  sgRNA
  Vnn3_17
ggtggttgtgaaggacaccc

SEQ ID NO: 64365 - DNA, 20 bp, Artificial Sequence
  sgRNA
  Vnn3_18
agaacttgtggggaacccgt

SEQ ID NO: 64366 - DNA, 20 bp, Artificial Sequence
  sgRNA
  Vnn3_19
gaccctccgcgcttagggca

SEQ ID NO: 64367 - DNA, 20 bp, Artificial Sequence
  sgRNA
  Vnn3_20
tctgcctgccccgatgagaa

SEQ ID NO: 64368 - DNA, 20 bp, Artificial Sequence
  sgRNA
  Vsig1_1
attactggtataagattgag

SEQ ID NO: 64369 - DNA, 20 bp, Artificial Sequence
  sgRNA
  Vsig1_2
attcaaagaccgaataattg

SEQ ID NO: 64370 - DNA, 20 bp, Artificial Sequence
  sgRNA
  Vsig1_3
gactgttgatggcagtacac

SEQ ID NO: 64371 - DNA, 20 bp, Artificial Sequence
  sgRNA
  Vsig1_4
ctaagacagtgacgtcaagg

SEQ ID NO: 64372 - DNA, 20 bp, Artificial Sequence
  sgRNA
  Vsig1_5
catatgcagccagcagacag

SEQ ID NO: 64373 - DNA, 20 bp, Artificial Sequence
  sgRNA
  Vsig1_6
gctttggtcggtgccctgat

SEQ ID NO: 64374 - DNA, 20 bp, Artificial Sequence
  sgRNA
  Vsig1_7
acaccatccccaacaaagtg

SEQ ID NO: 64375 - DNA, 20 bp, Artificial Sequence
  sgRNA
  Vsig1_8
cagcctgaccctgaaccaga

SEQ ID NO: 64376 - DNA, 20 bp, Artificial Sequence
  sgRNA
  Vsig1_9
gattagtagccccaattatt

SEQ ID NO: 64377 - DNA, 20 bp, Artificial Sequence
  sgRNA
  Vsig1_10
tggaaaagctttcaattcaa

SEQ ID NO: 64378 - DNA, 20 bp, Artificial Sequence
  sgRNA
  Vsig1_11
ggctgtgtggtagtttccag

SEQ ID NO: 64379 - DNA, 20 bp, Artificial Sequence
  sgRNA
  Vsig1_12
atatgagcctaatcctccac

SEQ ID NO: 64380 - DNA, 20 bp, Artificial Sequence
  sgRNA
  Vsig1_13
gctgatggcgtccagctaga

SEQ ID NO: 64381 - DNA, 20 bp, Artificial Sequence
  sgRNA
  Vsig1_14
gctcctccatttccttattg

SEQ ID NO: 64382 - DNA, 20 bp, Artificial Sequence
  sgRNA
  Vsig1_15
ctactactctgaaggtggac

SEQ ID NO: 64383 - DNA, 20 bp, Artificial Sequence
  sgRNA
  Vsig1_16
agacgttaagtcaatttcac

SEQ ID NO: 64384 - DNA, 20 bp, Artificial Sequence
  sgRNA
  Vsig1_17
acggtgttccaaaggcagaa

SEQ ID NO: 64385 - DNA, 20 bp, Artificial Sequence
  sgRNA
  Vsig1_18
tgtgtggtagtttccagtgg

SEQ ID NO: 64386 - DNA, 20 bp, Artificial Sequence
  sgRNA
  Vsig1_19
taccagtaatacaaaggaga

SEQ ID NO: 64387 - DNA, 20 bp, Artificial Sequence
  sgRNA
  Vsig1_20
agctgctgttatcatctgtg

SEQ ID NO: 64388 - DNA, 20 bp, Artificial Sequence
  sgRNA
  Vsig10_1
tgagatgttaacttccacgt

SEQ ID NO: 64389 - DNA, 20 bp, Artificial Sequence
  sgRNA
  Vsig10_2
cccgaccttcttgtggaccg

SEQ ID NO: 64390 - DNA, 20 bp, Artificial Sequence
  sgRNA
  Vsig10_3
agcgtagagtaacgttgtcg

SEQ ID NO: 64391 - DNA, 20 bp, Artificial Sequence
  sgRNA
  Vsig10_4
catgagaacttgcttcgtgg

SEQ ID NO: 64392 - DNA, 20 bp, Artificial Sequence
  sgRNA
  Vsig10_5
ttgttgccctcacccccacg

SEQ ID NO: 64393 - DNA, 20 bp, Artificial Sequence
  sgRNA
  Vsig10_6
gccactggatcctcgcaggt

SEQ ID NO: 64394 - DNA, 20 bp, Artificial Sequence
  sgRNA
  Vsig10_7
cccacgaagcaagttctcat

SEQ ID NO: 64395 - DNA, 20 bp, Artificial Sequence
  sgRNA
  Vsig10_8
tctacgctgtggcagcgcgt

SEQ ID NO: 64396 - DNA, 20 bp, Artificial Sequence
  sgRNA
  Vsig10_9
agcccggcgcagctgttgga

SEQ ID NO: 64397 - DNA, 20 bp, Artificial Sequence
  sgRNA
  Vsig10_10
tctcagtgcctcaatacgca

SEQ ID NO: 64398 - DNA, 20 bp, Artificial Sequence
  sgRNA
  Vsig10_11
gtacagcgtgccgttgggga

SEQ ID NO: 64399 - DNA, 20 bp, Artificial Sequence
  sgRNA
  Vsig10_12
tcctcggtccacaagaaggt

SEQ ID NO: 64400 - DNA, 20 bp, Artificial Sequence
  sgRNA
  Vsig10_13
gcagcagttgaagtccacct

SEQ ID NO: 64401 - DNA, 20 bp, Artificial Sequence
  sgRNA
  Vsig10_14
gttgggccggacagacaagt

SEQ ID NO: 64402 - DNA, 20 bp, Artificial Sequence
  sgRNA
  Vsig10_15
gctgcgtacagcgtgccgtt

SEQ ID NO: 64403 - DNA, 20 bp, Artificial Sequence
  sgRNA
  Vsig10_16
acgatgcccccgatgttcag

SEQ ID NO: 64404 - DNA, 20 bp, Artificial Sequence
  sgRNA
  Vsig10_17
tgttaacttccacgtaggca

SEQ ID NO: 64405 - DNA, 20 bp, Artificial Sequence
  sgRNA
  Vsig10_18
gcaagaagttcaaatgcgtt

SEQ ID NO: 64406 - DNA, 20 bp, Artificial Sequence
  sgRNA
  Vsig10_19
gcgtgaagctgttggccgac

SEQ ID NO: 64407 - DNA, 20 bp, Artificial Sequence
  sgRNA
  Vsig10_20
ccaggccgagaacctcgtgg

SEQ ID NO: 64408 - DNA, 20 bp, Artificial Sequence
  sgRNA
  Vsig10l_1
tcttcccgaaggcgtccgag

SEQ ID NO: 64409 - DNA, 20 bp, Artificial Sequence
  sgRNA
  Vsig10l_2
ggttgaacactgaacgccgg

SEQ ID NO: 64410 - DNA, 20 bp, Artificial Sequence
  sgRNA
  Vsig10l_3
gagatttgaccagattcgag

SEQ ID NO: 64411 - DNA, 20 bp, Artificial Sequence
  sgRNA
  Vsig10l_4
gctgctccagcccatagtag

SEQ ID NO: 64412 - DNA, 20 bp, Artificial Sequence
  sgRNA
  Vsig10l_5
tagatggcaccggtcccgct

SEQ ID NO: 64413 - DNA, 20 bp, Artificial Sequence
  sgRNA
  Vsig10l_6
tggctgcccgaacagtccat

SEQ ID NO: 64414 - DNA, 20 bp, Artificial Sequence
  sgRNA
  Vsig10l_7
gccaggagcagcgaaagcgg

SEQ ID NO: 64415 - DNA, 20 bp, Artificial Sequence
  sgRNA
  Vsig10l_8
gcagctggtcccgttctgtg

SEQ ID NO: 64416 - DNA, 20 bp, Artificial Sequence
  sgRNA
  Vsig10l_9
acacccctgcatcatccagc

SEQ ID NO: 64417 - DNA, 20 bp, Artificial Sequence
  sgRNA
  Vsig10l_10
cagactccacgcgatgtccg

SEQ ID NO: 64418 - DNA, 20 bp, Artificial Sequence
  sgRNA
  Vsig10l_11
ctgcccggctggatgatgca

SEQ ID NO: 64419 - DNA, 20 bp, Artificial Sequence
  sgRNA
  Vsig10l_12
tgaggttgaacactgaacgc

SEQ ID NO: 64420 - DNA, 20 bp, Artificial Sequence
  sgRNA
  Vsig10l_13
ccatcaagagacactctgga

SEQ ID NO: 64421 - DNA, 20 bp, Artificial Sequence
  sgRNA
  Vsig10l_14
gtgaagctggagtcttgacg

SEQ ID NO: 64422 - DNA, 20 bp, Artificial Sequence
  sgRNA
  Vsig10l_15
tcccgttctgtgcggatgcg

SEQ ID NO: 64423 - DNA, 20 bp, Artificial Sequence
  sgRNA
  Vsig10l_16
ctgttcctcagcggaaacat

SEQ ID NO: 64424 - DNA, 20 bp, Artificial Sequence
  sgRNA
  Vsig10l_17
gcctcctcctcacactccat

SEQ ID NO: 64425 - DNA, 20 bp, Artificial Sequence
  sgRNA
  Vsig10l_18
gtttgaaacaaagtcccgag

SEQ ID NO: 64426 - DNA, 20 bp, Artificial Sequence
  sgRNA
  Vsig10l_19
gagcattgtggggctccggg

SEQ ID NO: 64427 - DNA, 20 bp, Artificial Sequence
  sgRNA
  Vsig10l_20
tgcgaaaagcccaggtccca

SEQ ID NO: 64428 - DNA, 20 bp, Artificial Sequence
  sgRNA
  Vsig2_1
gagctgcagttacaaaacat

SEQ ID NO: 64429 - DNA, 20 bp, Artificial Sequence
  sgRNA
  Vsig2_2
cgttggtgtagaaatctggt

SEQ ID NO: 64430 - DNA, 20 bp, Artificial Sequence
  sgRNA
  Vsig2_3
acccaagccagtgtacaact

SEQ ID NO: 64431 - DNA, 20 bp, Artificial Sequence
  sgRNA
  Vsig2_4
tagagccagtgggatacagg

SEQ ID NO: 64432 - DNA, 20 bp, Artificial Sequence
  sgRNA
  Vsig2_5
gttgattaaccccaacccgt

SEQ ID NO: 64433 - DNA, 20 bp, Artificial Sequence
  sgRNA
  Vsig2_6
gagcgtgccaaagggtaaga

SEQ ID NO: 64434 - DNA, 20 bp, Artificial Sequence
  sgRNA
  Vsig2_7
gttgctggccacacatcggt

SEQ ID NO: 64435 - DNA, 20 bp, Artificial Sequence
  sgRNA
  Vsig2_8
gcggaggtcagtcagtttca

SEQ ID NO: 64436 - DNA, 20 bp, Artificial Sequence
  sgRNA
  Vsig2_9
gcaaaggaaagcccccacca

SEQ ID NO: 64437 - DNA, 20 bp, Artificial Sequence
  sgRNA
  Vsig2_10
gtgggttgttaacattgcag

SEQ ID NO: 64438 - DNA, 20 bp, Artificial Sequence
  sgRNA
  Vsig2_11
aatggccacctgtatcccac

SEQ ID NO: 64439 - DNA, 20 bp, Artificial Sequence
  sgRNA
  Vsig2_12
ttgctcaaaaaccccaggag

SEQ ID NO: 64440 - DNA, 20 bp, Artificial Sequence
  sgRNA
  Vsig2_13
tgaaccatgctaccaggagg

SEQ ID NO: 64441 - DNA, 20 bp, Artificial Sequence
  sgRNA
  Vsig2_14
ctacccccataggtctcctt

SEQ ID NO: 64442 - DNA, 20 bp, Artificial Sequence
  sgRNA
  Vsig2_15
ctgcagttacaaaacatcgg

SEQ ID NO: 64443 - DNA, 20 bp, Artificial Sequence
  sgRNA
  Vsig2_16
tctggttgctggccacacat

SEQ ID NO: 64444 - DNA, 20 bp, Artificial Sequence
  sgRNA
  Vsig2_17
cgatctgctttagagccagt

SEQ ID NO: 64445 - DNA, 20 bp, Artificial Sequence
  sgRNA
  Vsig2_18
agatttctacaccaacgggt

SEQ ID NO: 64446 - DNA, 20 bp, Artificial Sequence
  sgRNA
  Vsig2_19
tgtgtggccagcaaccagat

SEQ ID NO: 64447 - DNA, 20 bp, Artificial Sequence
  sgRNA
  Vsig2_20
gggtggatcgtggagaagga

SEQ ID NO: 64448 - DNA, 20 bp, Artificial Sequence
  sgRNA
  Vsig8_1
ttccacagcaccatcaacca

SEQ ID NO: 64449 - DNA, 20 bp, Artificial Sequence
  sgRNA
  Vsig8_2
tggccttccgtccaacacat

SEQ ID NO: 64450 - DNA, 20 bp, Artificial Sequence
  sgRNA
  Vsig8_3
cagcgagtaggcatgatcgt

SEQ ID NO: 64451 - DNA, 20 bp, Artificial Sequence
  sgRNA
  Vsig8_4
acttatcaagacaagaggat

SEQ ID NO: 64452 - DNA, 20 bp, Artificial Sequence
  sgRNA
  Vsig8_5
gcatcaacgcagacgacgat

SEQ ID NO: 64453 - DNA, 20 bp, Artificial Sequence
  sgRNA
  Vsig8_6
gtctgctgtaaggatcaacg

SEQ ID NO: 64454 - DNA, 20 bp, Artificial Sequence
  sgRNA
  Vsig8_7
ccgaggtgccttcggctacg

SEQ ID NO: 64455 - DNA, 20 bp, Artificial Sequence
  sgRNA
  Vsig8_8
cttgaccttgatgtagacgg

SEQ ID NO: 64456 - DNA, 20 bp, Artificial Sequence
  sgRNA
  Vsig8_9
gcacgagcgctgctcgacct

SEQ ID NO: 64457 - DNA, 20 bp, Artificial Sequence
  sgRNA
  Vsig8_10
ggtaagccccagctcggtag

SEQ ID NO: 64458 - DNA, 20 bp, Artificial Sequence
  sgRNA
  Vsig8_11
cgtacttgcggcgcagggag

SEQ ID NO: 64459 - DNA, 20 bp, Artificial Sequence
  sgRNA
  Vsig8_12
aagtacgcgcctccgccctg

SEQ ID NO: 64460 - DNA, 20 bp, Artificial Sequence
  sgRNA
  Vsig8_13
aggcgcgtacttgcggcgca

SEQ ID NO: 64461 - DNA, 20 bp, Artificial Sequence
  sgRNA
  Vsig8_14
ccaacagtctggacattgag

SEQ ID NO: 64462 - DNA, 20 bp, Artificial Sequence
  sgRNA
  Vsig8_15
acggaaggccacatgtcaaa

SEQ ID NO: 64463 - DNA, 20 bp, Artificial Sequence
  sgRNA
  Vsig8_16
aacggagacctgctgttgaa

SEQ ID NO: 64464 - DNA, 20 bp, Artificial Sequence
  sgRNA
  Vsig8_17
tgggctgtatcagtgcacag

SEQ ID NO: 64465 - DNA, 20 bp, Artificial Sequence
  sgRNA
  Vsig8_18
cagtcacccctaccgagctg

SEQ ID NO: 64466 - DNA, 20 bp, Artificial Sequence
  sgRNA
  Vsig8_19
gtgagtggtaagccccagct

SEQ ID NO: 64467 - DNA, 20 bp, Artificial Sequence
  sgRNA
  Vsig8_20
ttgtctgctgtaaggatcaa

SEQ ID NO: 64468 - DNA, 20 bp, Artificial Sequence
  sgRNA
  Vstm4_1
tcctcggcgacggaaatgag

SEQ ID NO: 64469 - DNA, 20 bp, Artificial Sequence
  sgRNA
  Vstm4_2
aggggcgaagaaccagcgca

SEQ ID NO: 64470 - DNA, 20 bp, Artificial Sequence
  sgRNA
  Vstm4_3
cgcctgctcgaggagcgtcg

SEQ ID NO: 64471 - DNA, 20 bp, Artificial Sequence
  sgRNA
  Vstm4_4
ggcagtctgtgtttcacaag

SEQ ID NO: 64472 - DNA, 20 bp, Artificial Sequence
  sgRNA
  Vstm4_5
cctgctcgaggagcgtcgag

SEQ ID NO: 64473 - DNA, 20 bp, Artificial Sequence
  sgRNA
  Vstm4_6
gtatgcacagatcctcttcg

SEQ ID NO: 64474 - DNA, 20 bp, Artificial Sequence
  sgRNA
  Vstm4_7
agactgccaggcaatgacca

SEQ ID NO: 64475 - DNA, 20 bp, Artificial Sequence
  sgRNA
  Vstm4_8
gatcagctccagctcggcat

SEQ ID NO: 64476 - DNA, 20 bp, Artificial Sequence
  sgRNA
  Vstm4_9
cgtctcccagaagagacgga

SEQ ID NO: 64477 - DNA, 20 bp, Artificial Sequence
  sgRNA
  Vstm4_10
tcagcaagcaccgcaacaag

SEQ ID NO: 64478 - DNA, 20 bp, Artificial Sequence
  sgRNA
  Vstm4_11
tgtggtggactacttggaag

SEQ ID NO: 64479 - DNA, 20 bp, Artificial Sequence
  sgRNA
  Vstm4_12
tggtgaagatgacgaagctc

SEQ ID NO: 64480 - DNA, 20 bp, Artificial Sequence
  sgRNA
  Vstm4_13
gccccactgcagccacagaa

SEQ ID NO: 64481 - DNA, 20 bp, Artificial Sequence
  sgRNA
  Vstm4_14
gcagaggctacgcctgctcg

SEQ ID NO: 64482 - DNA, 20 bp, Artificial Sequence
  sgRNA
  Vstm4_15
accaggctgtccacttgttg

SEQ ID NO: 64483 - DNA, 20 bp, Artificial Sequence
  sgRNA
  Vstm4_16
gccggactgccaaccagcag

SEQ ID NO: 64484 - DNA, 20 bp, Artificial Sequence
  sgRNA
  Vstm4_17
gccacgtctcccagaagaga

SEQ ID NO: 64485 - DNA, 20 bp, Artificial Sequence
  sgRNA
  Vstm4_18
tcttcaccctggtcattgcc

SEQ ID NO: 64486 - DNA, 20 bp, Artificial Sequence
  sgRNA
  Vstm4_19
gggtgaagagcagaacactg

SEQ ID NO: 64487 - DNA, 20 bp, Artificial Sequence
  sgRNA
  Vstm4_20
tccgtctcttctgggagacg

SEQ ID NO: 64488 - DNA, 20 bp, Artificial Sequence
  sgRNA
  Vstm5_1
atggcgtgcccactattgag

SEQ ID NO: 64489 - DNA, 20 bp, Artificial Sequence
  sgRNA
  Vstm5_2
tcactgtcacagagcatccg

SEQ ID NO: 64490 - DNA, 20 bp, Artificial Sequence
  sgRNA
  Vstm5_3
gtggcgttgatggccgactg

SEQ ID NO: 64491 - DNA, 20 bp, Artificial Sequence
  sgRNA
  Vstm5_4
ctcctaactggggtgtgcag

SEQ ID NO: 64492 - DNA, 20 bp, Artificial Sequence
  sgRNA
  Vstm5_5
gctgattagcaccacagcca

SEQ ID NO: 64493 - DNA, 20 bp, Artificial Sequence
  sgRNA
  Vstm5_6
actcaatagtgggcacgcca

SEQ ID NO: 64494 - DNA, 20 bp, Artificial Sequence
  sgRNA
  Vstm5_7
ggtgctaatcagcctcatgt

SEQ ID NO: 64495 - DNA, 20 bp, Artificial Sequence
  sgRNA
  Vstm5_8
cgaagtggaggtcttcatag

SEQ ID NO: 64496 - DNA, 20 bp, Artificial Sequence
  sgRNA
  Vstm5_9
gtgtacttccactcaatagt

SEQ ID NO: 64497 - DNA, 20 bp, Artificial Sequence
  sgRNA
  Vstm5_10
agaagacagcaacgaagtgg

SEQ ID NO: 64498 - DNA, 20 bp, Artificial Sequence
  sgRNA
  Vstm5_11
tcagtggactacatctgcca

SEQ ID NO: 64499 - DNA, 20 bp, Artificial Sequence
  sgRNA
  Vstm5_12
agatgtagtccactgacaac

SEQ ID NO: 64500 - DNA, 20 bp, Artificial Sequence
  sgRNA
  Vstm5_13
actcacattgaaaagctgga

SEQ ID NO: 64501 - DNA, 20 bp, Artificial Sequence
  sgRNA
  Vstm5_14
ataaattccaaaggaagagg

SEQ ID NO: 64502 - DNA, 20 bp, Artificial Sequence
  sgRNA
  Vstm5_15
gtgccagactggctgctccc

SEQ ID NO: 64503 - DNA, 20 bp, Artificial Sequence
  sgRNA
  Vstm5_16
gtgtgcagaggatcgtggag

SEQ ID NO: 64504 - DNA, 20 bp, Artificial Sequence
  sgRNA
  Vstm5_17
actgattgcaaacccacatg

SEQ ID NO: 64505 - DNA, 20 bp, Artificial Sequence
  sgRNA
  Vstm5_18
tctgtggctttgggagacat

SEQ ID NO: 64506 - DNA, 20 bp, Artificial Sequence
  sgRNA
  Vstm5_19
ggatcgtggagtggaaacca

SEQ ID NO: 64507 - DNA, 20 bp, Artificial Sequence
  sgRNA
  Vstm5_20
caggatatcttgttggacag

SEQ ID NO: 64508 - DNA, 20 bp, Artificial Sequence
  sgRNA
  Vtcn1_1
aaagccaatgatgagtgcga

SEQ ID NO: 64509 - DNA, 20 bp, Artificial Sequence
  sgRNA
  Vtcn1_2
ggtgcggatgtaacatgtgt

SEQ ID NO: 64510 - DNA, 20 bp, Artificial Sequence
  sgRNA
  Vtcn1_3
aaccttgagtataagaccgg

SEQ ID NO: 64511 - DNA, 20 bp, Artificial Sequence
  sgRNA
  Vtcn1_4
tcaacggcatcgtcatccag

SEQ ID NO: 64512 - DNA, 20 bp, Artificial Sequence
  sgRNA
  Vtcn1_5
gcaaaccttgagtataagac

SEQ ID NO: 64513 - DNA, 20 bp, Artificial Sequence
  sgRNA
  Vtcn1_6
tgtcactttgatgtccccgg

SEQ ID NO: 64514 - DNA, 20 bp, Artificial Sequence
  sgRNA
  Vtcn1_7
acgacattgccaaagccacc

SEQ ID NO: 64515 - DNA, 20 bp, Artificial Sequence
  sgRNA
  Vtcn1_8
ttcagagagtttacgctgcg

SEQ ID NO: 64516 - DNA, 20 bp, Artificial Sequence
  sgRNA
  Vtcn1_9
gttcaactcaaagctggtgt

SEQ ID NO: 64517 - DNA, 20 bp, Artificial Sequence
  sgRNA
  Vtcn1_10
ggcagaagaaaaaacacacg

SEQ ID NO: 64518 - DNA, 20 bp, Artificial Sequence
  sgRNA
  Vtcn1_11
gtttacgctgcgaggctcct

SEQ ID NO: 64519 - DNA, 20 bp, Artificial Sequence
  sgRNA
  Vtcn1_12
gaacctgacatcaaactcaa

SEQ ID NO: 64520 - DNA, 20 bp, Artificial Sequence
  sgRNA
  Vtcn1_13
tgttacatccgcacctcaaa

SEQ ID NO: 64521 - DNA, 20 bp, Artificial Sequence
  sgRNA
  Vtcn1_14
tccgcacctcaaaaggcaaa

SEQ ID NO: 64522 - DNA, 20 bp, Artificial Sequence
  sgRNA
  Vtcn1_15
ccaaaagatgatctgcccca

SEQ ID NO: 64523 - DNA, 20 bp, Artificial Sequence
  sgRNA
  Vtcn1_16
cgacattgccaaagccaccg

SEQ ID NO: 64524 - DNA, 20 bp, Artificial Sequence
  sgRNA
  Vtcn1_17
ttatagtccacatttatctc

SEQ ID NO: 64525 - DNA, 20 bp, Artificial Sequence
  sgRNA
  Vtcn1_18
gtggttcccccagcccacag

SEQ ID NO: 64526 - DNA, 20 bp, Artificial Sequence
  sgRNA
  Vtcn1_19
tgggcatctcaagtcgacca

SEQ ID NO: 64527 - DNA, 20 bp, Artificial Sequence
  sgRNA
  Vtcn1_20
cagcagcatgagatgttcag

SEQ ID NO: 64528 - DNA, 20 bp, Artificial Sequence
  sgRNA
  Xcr1_1
cattgtgctgagatcaacac

SEQ ID NO: 64529 - DNA, 20 bp, Artificial Sequence
  sgRNA
  Xcr1_2
cacatgatgtcaccagcaca

SEQ ID NO: 64530 - DNA, 20 bp, Artificial Sequence
  sgRNA
  Xcr1_3
tcactacagacaggtatcgg

SEQ ID NO: 64531 - DNA, 20 bp, Artificial Sequence
  sgRNA
  Xcr1_4
aatttaaggagatcactttg

SEQ ID NO: 64532 - DNA, 20 bp, Artificial Sequence
  sgRNA
  Xcr1_5
ggatacccagagtagagatg

SEQ ID NO: 64533 - DNA, 20 bp, Artificial Sequence
  sgRNA
  Xcr1_6
tagaggactccatctggacg

SEQ ID NO: 64534 - DNA, 20 bp, Artificial Sequence
  sgRNA
  Xcr1_7
cctaaaacatctcttccagc

SEQ ID NO: 64535 - DNA, 20 bp, Artificial Sequence
  sgRNA
  Xcr1_8
gaggaagtatgctaccacga

SEQ ID NO: 64536 - DNA, 20 bp, Artificial Sequence
  sgRNA
  Xcr1_9
tcaccaagacccacaaaacc

SEQ ID NO: 64537 - DNA, 20 bp, Artificial Sequence
  sgRNA
  Xcr1_10
gtatcggtggatggtcatga

SEQ ID NO: 64538 - DNA, 20 bp, Artificial Sequence
  sgRNA
  Xcr1_11
ggctcactacagacaggtat

SEQ ID NO: 64539 - DNA, 20 bp, Artificial Sequence
  sgRNA
  Xcr1_12
cctcatatgtaaaggtacca

SEQ ID NO: 64540 - DNA, 20 bp, Artificial Sequence
  sgRNA
  Xcr1_13
gtatttctcctcagccttgt

SEQ ID NO: 64541 - DNA, 20 bp, Artificial Sequence
  sgRNA
  Xcr1_14
ctttgtggaagacagcatca

SEQ ID NO: 64542 - DNA, 20 bp, Artificial Sequence
  sgRNA
  Xcr1_15
ggatgattcccatggagagg

SEQ ID NO: 64543 - DNA, 20 bp, Artificial Sequence
  sgRNA
  Xcr1_16
agaggactccatctggacgc

SEQ ID NO: 64544 - DNA, 20 bp, Artificial Sequence
  sgRNA
  Xcr1_17
ataggatgattcccatggag

SEQ ID NO: 64545 - DNA, 20 bp, Artificial Sequence
  sgRNA
  Xcr1_18
acagaataggatgattccca

SEQ ID NO: 64546 - DNA, 20 bp, Artificial Sequence
  sgRNA
  Xcr1_19
ggtctgagagacacaggttg

SEQ ID NO: 64547 - DNA, 20 bp, Artificial Sequence
  sgRNA
  Xcr1_20
ggtagcatacttcctcagct

SEQ ID NO: 64548 - DNA, 20 bp, Artificial Sequence
  sgRNA
  Xpnpep2_1
ctgccgtcaatacaacaatg

SEQ ID NO: 64549 - DNA, 20 bp, Artificial Sequence
  sgRNA
  Xpnpep2_2
accttgttgacgtggcatgg

SEQ ID NO: 64550 - DNA, 20 bp, Artificial Sequence
  sgRNA
  Xpnpep2_3
cacttcatagaccccatagg

SEQ ID NO: 64551 - DNA, 20 bp, Artificial Sequence
  sgRNA
  Xpnpep2_4
aatacattgatgagttacga

SEQ ID NO: 64552 - DNA, 20 bp, Artificial Sequence
  sgRNA
  Xpnpep2_5
ggtcagctataccacctatg

SEQ ID NO: 64553 - DNA, 20 bp, Artificial Sequence
  sgRNA
  Xpnpep2_6
ggtccaggagatgatatgag

SEQ ID NO: 64554 - DNA, 20 bp, Artificial Sequence
  sgRNA
  Xpnpep2_7
acattggcaaacctgataag

SEQ ID NO: 64555 - DNA, 20 bp, Artificial Sequence
  sgRNA
  Xpnpep2_8
gggtcagctataccacctat

SEQ ID NO: 64556 - DNA, 20 bp, Artificial Sequence
  sgRNA
  Xpnpep2_9
ggtctccatctgttggcgga

SEQ ID NO: 64557 - DNA, 20 bp, Artificial Sequence
  sgRNA
  Xpnpep2_10
atatcaccagaacagtacat

SEQ ID NO: 64558 - DNA, 20 bp, Artificial Sequence
  sgRNA
  Xpnpep2_11
gttactggactcaggccgaa

SEQ ID NO: 64559 - DNA, 20 bp, Artificial Sequence
  sgRNA
  Xpnpep2_12
tagtctgtggaaactcagag

SEQ ID NO: 64560 - DNA, 20 bp, Artificial Sequence
  sgRNA
  Xpnpep2_13
tcctcaagttgcacacacat

SEQ ID NO: 64561 - DNA, 20 bp, Artificial Sequence
  sgRNA
  Xpnpep2_14
ctatgatcttgggagctcgt

SEQ ID NO: 64562 - DNA, 20 bp, Artificial Sequence
  sgRNA
  Xpnpep2_15
ggttggttgtaaccgataac

SEQ ID NO: 64563 - DNA, 20 bp, Artificial Sequence
  sgRNA
  Xpnpep2_16
ggagttcgtgagcagtgcat

SEQ ID NO: 64564 - DNA, 20 bp, Artificial Sequence
  sgRNA
  Xpnpep2_17
tctccaaccagaccaagtac

SEQ ID NO: 64565 - DNA, 20 bp, Artificial Sequence
  sgRNA
  Xpnpep2_18
gcatttcttccattgtcgcc

SEQ ID NO: 64566 - DNA, 20 bp, Artificial Sequence
  sgRNA
  Xpnpep2_19
gtttcggtcatagggcacaa

SEQ ID NO: 64567 - DNA, 20 bp, Artificial Sequence
  sgRNA
  Xpnpep2_20
caagggcgacatcttcaaga

SEQ ID NO: 64568 - DNA, 20 bp, Artificial Sequence
  sgRNA
  Zan_1
actaccgttaccatgatcag

SEQ ID NO: 64569 - DNA, 20 bp, Artificial Sequence
  sgRNA
  Zan_2
ggtaagacttggatcaacag

SEQ ID NO: 64570 - DNA, 20 bp, Artificial Sequence
  sgRNA
  Zan_3
gggagagtgtcgcatctcag

SEQ ID NO: 64571 - DNA, 20 bp, Artificial Sequence
  sgRNA
  Zan_4
gcagctgaacaaccaaaggg

SEQ ID NO: 64572 - DNA, 20 bp, Artificial Sequence
  sgRNA
  Zan_5
ccttgcctaccacataccgt

SEQ ID NO: 64573 - DNA, 20 bp, Artificial Sequence
  sgRNA
  Zan_6
ggtcaacgatgaaaaggtgg

SEQ ID NO: 64574 - DNA, 20 bp, Artificial Sequence
  sgRNA
  Zan_7
ggaatgggaaaactacccgc

SEQ ID NO: 64575 - DNA, 20 bp, Artificial Sequence
  sgRNA
  Zan_8
tactgaacacaaagcccgag

SEQ ID NO: 64576 - DNA, 20 bp, Artificial Sequence
  sgRNA
  Zan_9
ttacgtccctccatgatcag

SEQ ID NO: 64577 - DNA, 20 bp, Artificial Sequence
  sgRNA
  Zan_10
gcctttctccaattgccacg

SEQ ID NO: 64578 - DNA, 20 bp, Artificial Sequence
  sgRNA
  Zan_11
agtcctccactaatgcccat

SEQ ID NO: 64579 - DNA, 20 bp, Artificial Sequence
  sgRNA
  Zan_12
agaggggtattacctgcaca

SEQ ID NO: 64580 - DNA, 20 bp, Artificial Sequence
  sgRNA
  Zan_13
tggttgcagtacgttccggg

SEQ ID NO: 64581 - DNA, 20 bp, Artificial Sequence
  sgRNA
  Zan_14
ccagagatgtacctgcaccg

SEQ ID NO: 64582 - DNA, 20 bp, Artificial Sequence
  sgRNA
  Zan_15
ttgtttattgaggccacccg

SEQ ID NO: 64583 - DNA, 20 bp, Artificial Sequence
  sgRNA
  Zan_16
gatgagctcatgacacccag

SEQ ID NO: 64584 - DNA, 20 bp, Artificial Sequence
  sgRNA
  Zan_17
gatagtagttcatacgaccc

SEQ ID NO: 64585 - DNA, 20 bp, Artificial Sequence
  sgRNA
  Zan_18
agaaatacccaccactccca

SEQ ID NO: 64586 - DNA, 20 bp, Artificial Sequence
  sgRNA
  Zan_19
tggcaacaagaacaaccatg

SEQ ID NO: 64587 - DNA, 20 bp, Artificial Sequence
  sgRNA
  Zan_20
cattcacagccctctacaca

SEQ ID NO: 64588 - DNA, 20 bp, Artificial Sequence
  sgRNA
  Zdhhc11_1
ctcacgcggtaacctcacac

SEQ ID NO: 64589 - DNA, 20 bp, Artificial Sequence
  sgRNA
  Zdhhc11_2
ttgcgatcaagtgcacgatg

SEQ ID NO: 64590 - DNA, 20 bp, Artificial Sequence
  sgRNA
  Zdhhc11_3
cagccattcaccctagacag

SEQ ID NO: 64591 - DNA, 20 bp, Artificial Sequence
  sgRNA
  Zdhhc11_4
tccagctatatggcagaaag

SEQ ID NO: 64592 - DNA, 20 bp, Artificial Sequence
  sgRNA
  Zdhhc11_5
tccgtgccatgctcatggaa

SEQ ID NO: 64593 - DNA, 20 bp, Artificial Sequence
  sgRNA
  Zdhhc11_6
gctttgaccaccactgcaaa

SEQ ID NO: 64594 - DNA, 20 bp, Artificial Sequence
  sgRNA
  Zdhhc11_7
gatccgtgcgaagctcatca

SEQ ID NO: 64595 - DNA, 20 bp, Artificial Sequence
  sgRNA
  Zdhhc11_8
caaatggctgaacaactgcg

SEQ ID NO: 64596 - DNA, 20 bp, Artificial Sequence
  sgRNA
  Zdhhc11_9
caaccctgatgagcttcgca

SEQ ID NO: 64597 - DNA, 20 bp, Artificial Sequence
  sgRNA
  Zdhhc11_10
tattgcctgaaaggagtgga

SEQ ID NO: 64598 - DNA, 20 bp, Artificial Sequence
  sgRNA
  Zdhhc11_11
atattgcctgaaaggagtgg

SEQ ID NO: 64599 - DNA, 20 bp, Artificial Sequence
  sgRNA
  Zdhhc11_12
aggtcccccttcttctgtag

SEQ ID NO: 64600 - DNA, 20 bp, Artificial Sequence
  sgRNA
  Zdhhc11_13
gcccttccatgagcatggca

SEQ ID NO: 64601 - DNA, 20 bp, Artificial Sequence
  sgRNA
  Zdhhc11_14
tcttgaatcgagtcttcatc

SEQ ID NO: 64602 - DNA, 20 bp, Artificial Sequence
  sgRNA
  Zdhhc11_15
tcccctttctgccatatagc

SEQ ID NO: 64603 - DNA, 20 bp, Artificial Sequence
  sgRNA
  Zdhhc11_16
aaatggctgaacaactgcgt

SEQ ID NO: 64604 - DNA, 20 bp, Artificial Sequence
  sgRNA
  Zdhhc11_17
ttccatgagcatggcacgga

SEQ ID NO: 64605 - DNA, 20 bp, Artificial Sequence
  sgRNA
  Zdhhc11_18
gcagcatatttccagctata

SEQ ID NO: 64606 - DNA, 20 bp, Artificial Sequence
  sgRNA
  Zdhhc11_19
aggatattgcctgaaaggag

SEQ ID NO: 64607 - DNA, 20 bp, Artificial Sequence
  sgRNA
  Zdhhc11_20
ttcaccctagacagagggcg

SEQ ID NO: 64608 - DNA, 20 bp, Artificial Sequence
  sgRNA
  Zdhhc5_1
cggacctcagccgatacacg

SEQ ID NO: 64609 - DNA, 20 bp, Artificial Sequence
  sgRNA
  Zdhhc5_2
agctcccctttacaaaacag

SEQ ID NO: 64610 - DNA, 20 bp, Artificial Sequence
  sgRNA
  Zdhhc5_3
tggcctcacaggatttcatg

SEQ ID NO: 64611 - DNA, 20 bp, Artificial Sequence
  sgRNA
  Zdhhc5_4
ctggccaatcagacacgcaa

SEQ ID NO: 64612 - DNA, 20 bp, Artificial Sequence
  sgRNA
  Zdhhc5_5
ccacctacagcaaatccaat

SEQ ID NO: 64613 - DNA, 20 bp, Artificial Sequence
  sgRNA
  Zdhhc5_6
tgaggaggaactagtacggg

SEQ ID NO: 64614 - DNA, 20 bp, Artificial Sequence
  sgRNA
  Zdhhc5_7
gagaggtgtagcctaaaggt

SEQ ID NO: 64615 - DNA, 20 bp, Artificial Sequence
  sgRNA
  Zdhhc5_8
agctcccactagaaatatgg

SEQ ID NO: 64616 - DNA, 20 bp, Artificial Sequence
  sgRNA
  Zdhhc5_9
atattgatcggcccaggtag

SEQ ID NO: 64617 - DNA, 20 bp, Artificial Sequence
  sgRNA
  Zdhhc5_10
tgtgctggccaactttagca

SEQ ID NO: 64618 - DNA, 20 bp, Artificial Sequence
  sgRNA
  Zdhhc5_11
tctgaggaggaactagtacg

SEQ ID NO: 64619 - DNA, 20 bp, Artificial Sequence
  sgRNA
  Zdhhc5_12
ccatctggtttgccaaaacg

SEQ ID NO: 64620 - DNA, 20 bp, Artificial Sequence
  sgRNA
  Zdhhc5_13
ttgtcataacggactggtga

SEQ ID NO: 64621 - DNA, 20 bp, Artificial Sequence
  sgRNA
  Zdhhc5_14
tataggatattgatcggccc

SEQ ID NO: 64622 - DNA, 20 bp, Artificial Sequence
  sgRNA
  Zdhhc5_15
gttacaggtaaattccgggg

SEQ ID NO: 64623 - DNA, 20 bp, Artificial Sequence
  sgRNA
  Zdhhc5_16
tatactcttgggctgcccat

SEQ ID NO: 64624 - DNA, 20 bp, Artificial Sequence
  sgRNA
  Zdhhc5_17
tgaagggattcacacctccc

SEQ ID NO: 64625 - DNA, 20 bp, Artificial Sequence
  sgRNA
  Zdhhc5_18
cccttgagtaagactccact

SEQ ID NO: 64626 - DNA, 20 bp, Artificial Sequence
  sgRNA
  Zdhhc5_19
ggtcgatacttgtacatggt

SEQ ID NO: 64627 - DNA, 20 bp, Artificial Sequence
  sgRNA
  Zdhhc5_20
gcagccgccatatttctagt

SEQ ID NO: 64628 - DNA, 20 bp, Artificial Sequence
  sgRNA
  Zfyve27_1
gaagagtgtgctatttaaca

SEQ ID NO: 64629 - DNA, 20 bp, Artificial Sequence
  sgRNA
  Zfyve27_2
ctcactgtgaggacaccacg

SEQ ID NO: 64630 - DNA, 20 bp, Artificial Sequence
  sgRNA
  Zfyve27_3
ccttaccctcgttcaaagtg

SEQ ID NO: 64631 - DNA, 20 bp, Artificial Sequence
  sgRNA
  Zfyve27_4
acggtgttcgatacttgcta

SEQ ID NO: 64632 - DNA, 20 bp, Artificial Sequence
  sgRNA
  Zfyve27_5
cttcagcacggagaacgtag

SEQ ID NO: 64633 - DNA, 20 bp, Artificial Sequence
  sgRNA
  Zfyve27_6
ggttctcccagtgaagtaca

SEQ ID NO: 64634 - DNA, 20 bp, Artificial Sequence
  sgRNA
  Zfyve27_7
gcggaggatgaacccccggc

SEQ ID NO: 64635 - DNA, 20 bp, Artificial Sequence
  sgRNA
  Zfyve27_8
tgtgagagctcagcactgca

SEQ ID NO: 64636 - DNA, 20 bp, Artificial Sequence
  sgRNA
  Zfyve27_9
gctcagggtctgattgcagg

SEQ ID NO: 64637 - DNA, 20 bp, Artificial Sequence
  sgRNA
  Zfyve27_10
gaggaatccattgtcctgca

SEQ ID NO: 64638 - DNA, 20 bp, Artificial Sequence
  sgRNA
  Zfyve27_11
gtgtgctatttaacagggcg

SEQ ID NO: 64639 - DNA, 20 bp, Artificial Sequence
  sgRNA
  Zfyve27_12
gggccaagaaggcttccagt

SEQ ID NO: 64640 - DNA, 20 bp, Artificial Sequence
  sgRNA
  Zfyve27_13
ggaacccctgaaggatgcag

SEQ ID NO: 64641 - DNA, 20 bp, Artificial Sequence
  sgRNA
  Zfyve27_14
aggtgtcccggcttacagag

SEQ ID NO: 64642 - DNA, 20 bp, Artificial Sequence
  sgRNA
  Zfyve27_15
ctacctgctaccgctctgct

SEQ ID NO: 64643 - DNA, 20 bp, Artificial Sequence
  sgRNA
  Zfyve27_16
taccttcaggaggtgtgccg

SEQ ID NO: 64644 - DNA, 20 bp, Artificial Sequence
  sgRNA
  Zfyve27_17
gcagcacctcattcttgctg

SEQ ID NO: 64645 - DNA, 20 bp, Artificial Sequence
  sgRNA
  Zfyve27_18
gggaaaggcgaactctctgc

SEQ ID NO: 64646 - DNA, 20 bp, Artificial Sequence
  sgRNA
  Zfyve27_19
ttaaatagcacactcttcct

SEQ ID NO: 64647 - DNA, 20 bp, Artificial Sequence
  sgRNA
  Zfyve27_20
tgagagctcagcactgcagg

SEQ ID NO: 64648 - DNA, 20 bp, Artificial Sequence
  sgRNA
  Znrf4_1
ccactacagggtgacactcg

SEQ ID NO: 64649 - DNA, 20 bp, Artificial Sequence
  sgRNA
  Znrf4_2
aagttaacctgagcgtccgt

SEQ ID NO: 64650 - DNA, 20 bp, Artificial Sequence
  sgRNA
  Znrf4_3
ggggccggaccagcactagt

SEQ ID NO: 64651 - DNA, 20 bp, Artificial Sequence
  sgRNA
  Znrf4_4
gtggaccccaagagggcacg

SEQ ID NO: 64652 - DNA, 20 bp, Artificial Sequence
  sgRNA
  Znrf4_5
cccaggatgcaaccactaca

SEQ ID NO: 64653 - DNA, 20 bp, Artificial Sequence
  sgRNA
  Znrf4_6
cagggggcatgaacgctgcg

SEQ ID NO: 64654 - DNA, 20 bp, Artificial Sequence
  sgRNA
  Znrf4_7
catctgcctggacgactacg

SEQ ID NO: 64655 - DNA, 20 bp, Artificial Sequence
  sgRNA
  Znrf4_8
tcagtggccagcactcacga

SEQ ID NO: 64656 - DNA, 20 bp, Artificial Sequence
  sgRNA
  Znrf4_9
catctacgctgttcgtgctg

SEQ ID NO: 64657 - DNA, 20 bp, Artificial Sequence
  sgRNA
  Znrf4_10
gcatgtctgcgtcttcaccg

SEQ ID NO: 64658 - DNA, 20 bp, Artificial Sequence
  sgRNA
  Znrf4_11
ggttcctgtggaccccaaga

SEQ ID NO: 64659 - DNA, 20 bp, Artificial Sequence
  sgRNA
  Znrf4_12
atacctgctggtggcccggc

SEQ ID NO: 64660 - DNA, 20 bp, Artificial Sequence
  sgRNA
  Znrf4_13
cagcactcacgacggttcca

SEQ ID NO: 64661 - DNA, 20 bp, Artificial Sequence
  sgRNA
  Znrf4_14
gaccagccagaaagtcacca

SEQ ID NO: 64662 - DNA, 20 bp, Artificial Sequence
  sgRNA
  Znrf4_15
gcactagtgggtccagtgag

SEQ ID NO: 64663 - DNA, 20 bp, Artificial Sequence
  sgRNA
  Znrf4_16
gaagacgcagacatgccaga

SEQ ID NO: 64664 - DNA, 20 bp, Artificial Sequence
  sgRNA
  Znrf4_17
ctacccaagccccggaccca

SEQ ID NO: 64665 - DNA, 20 bp, Artificial Sequence
  sgRNA
  Znrf4_18
acaggaaccccaagcagcgc

SEQ ID NO: 64666 - DNA, 20 bp, Artificial Sequence
  sgRNA
  Znrf4_19
gcctggatggcccagatggg

SEQ ID NO: 64667 - DNA, 20 bp, Artificial Sequence
  sgRNA
  Znrf4_20
ggtcctgtccctgtcgccca

SEQ ID NO: 64668 - DNA, 20 bp, Artificial Sequence
  sgRNA
  Zp1_1
tccttaccttctctagaacg

SEQ ID NO: 64669 - DNA, 20 bp, Artificial Sequence
  sgRNA
  Zp1_2
gggtccagattgagtcacag

SEQ ID NO: 64670 - DNA, 20 bp, Artificial Sequence
  sgRNA
  Zp1_3
tcccgagtgatggaaccctg

SEQ ID NO: 64671 - DNA, 20 bp, Artificial Sequence
  sgRNA
  Zp1_4
acaacgtagtgagaccagtg

SEQ ID NO: 64672 - DNA, 20 bp, Artificial Sequence
  sgRNA
  Zp1_5
gctatatccacacggccatt

SEQ ID NO: 64673 - DNA, 20 bp, Artificial Sequence
  sgRNA
  Zp1_6
tggagagcttacaatatcca

SEQ ID NO: 64674 - DNA, 20 bp, Artificial Sequence
  sgRNA
  Zp1_7
atacaagccgtcctacccaa

SEQ ID NO: 64675 - DNA, 20 bp, Artificial Sequence
  sgRNA
  Zp1_8
cctggattgctgttccacag

SEQ ID NO: 64676 - DNA, 20 bp, Artificial Sequence
  sgRNA
  Zp1_9
ggatgggcggttccacctga

SEQ ID NO: 64677 - DNA, 20 bp, Artificial Sequence
  sgRNA
  Zp1_10
gtattctcagctgattacaa

SEQ ID NO: 64678 - DNA, 20 bp, Artificial Sequence
  sgRNA
  Zp1_11
tccagctcagtcaattccca

SEQ ID NO: 64679 - DNA, 20 bp, Artificial Sequence
  sgRNA
  Zp1_12
gggcctcactggtcacccag

SEQ ID NO: 64680 - DNA, 20 bp, Artificial Sequence
  sgRNA
  Zp1_13
gagcatgtatcagaccccag

SEQ ID NO: 64681 - DNA, 20 bp, Artificial Sequence
  sgRNA
  Zp1_14
cggcttgtatgaacaccctc

SEQ ID NO: 64682 - DNA, 20 bp, Artificial Sequence
  sgRNA
  Zp1_15
gcgctgatagtgggaccaga

SEQ ID NO: 64683 - DNA, 20 bp, Artificial Sequence
  sgRNA
  Zp1_16
ttcccggagcagtctcacaa

SEQ ID NO: 64684 - DNA, 20 bp, Artificial Sequence
  sgRNA
  Zp1_17
agcatgtatcagaccccaga

SEQ ID NO: 64685 - DNA, 20 bp, Artificial Sequence
  sgRNA
  Zp1_18
ggatattgtaagctctccag

SEQ ID NO: 64686 - DNA, 20 bp, Artificial Sequence
  sgRNA
  Zp1_19
agtcggacctctacatagac

SEQ ID NO: 64687 - DNA, 20 bp, Artificial Sequence
  sgRNA
  Zp1_20
gtacccatctgccccaggag

SEQ ID NO: 64688 - DNA, 20 bp, Artificial Sequence
  sgRNA
  Zp2_1
tactggaatagttcactatg

SEQ ID NO: 64689 - DNA, 20 bp, Artificial Sequence
  sgRNA
  Zp2_2
tttatatctcacatcagtgg

SEQ ID NO: 64690 - DNA, 20 bp, Artificial Sequence
  sgRNA
  Zp2_3
tactacatacccaccacaga

SEQ ID NO: 64691 - DNA, 20 bp, Artificial Sequence
  sgRNA
  Zp2_4
acatgcttacctatagagac

SEQ ID NO: 64692 - DNA, 20 bp, Artificial Sequence
  sgRNA
  Zp2_5
tttgtaggaccaacaccagt

SEQ ID NO: 64693 - DNA, 20 bp, Artificial Sequence
  sgRNA
  Zp2_6
ccatgtagattggctggcgg

SEQ ID NO: 64694 - DNA, 20 bp, Artificial Sequence
  sgRNA
  Zp2_7
agaggaatttcccaccagga

SEQ ID NO: 64695 - DNA, 20 bp, Artificial Sequence
  sgRNA
  Zp2_8
cctttgtatcagaggcacgg

SEQ ID NO: 64696 - DNA, 20 bp, Artificial Sequence
  sgRNA
  Zp2_9
cagctgggtggaaagtagtg

SEQ ID NO: 64697 - DNA, 20 bp, Artificial Sequence
  sgRNA
  Zp2_10
ctaccaacggccttacagga

SEQ ID NO: 64698 - DNA, 20 bp, Artificial Sequence
  sgRNA
  Zp2_11
agctgaccttctacttccaa

SEQ ID NO: 64699 - DNA, 20 bp, Artificial Sequence
  sgRNA
  Zp2_12
cagcagctctgagattacca

SEQ ID NO: 64700 - DNA, 20 bp, Artificial Sequence
  sgRNA
  Zp2_13
tgtactatggcatccttcaa

SEQ ID NO: 64701 - DNA, 20 bp, Artificial Sequence
  sgRNA
  Zp2_14
cgagacctgcactataaaag

SEQ ID NO: 64702 - DNA, 20 bp, Artificial Sequence
  sgRNA
  Zp2_15
gcacgtggagagttactttc

SEQ ID NO: 64703 - DNA, 20 bp, Artificial Sequence
  sgRNA
  Zp2_16
ggcggaggtacctcactaga

SEQ ID NO: 64704 - DNA, 20 bp, Artificial Sequence
  sgRNA
  Zp2_17
aggtcagcttgagtgaagag

SEQ ID NO: 64705 - DNA, 20 bp, Artificial Sequence
  sgRNA
  Zp2_18
gcatctgtaagctctccgtg

SEQ ID NO: 64706 - DNA, 20 bp, Artificial Sequence
  sgRNA
  Zp2_19
actgcaccttgaaaataggc

SEQ ID NO: 64707 - DNA, 20 bp, Artificial Sequence
  sgRNA
  Zp2_20
gcaagcctagagaaaagttg

SEQ ID NO: 64708 - DNA, 20 bp, Artificial Sequence
  sgRNA
  Zp3_1
agagactctccagttcacgg

SEQ ID NO: 64709 - DNA, 20 bp, Artificial Sequence
  sgRNA
  Zp3_2
ggtgtccgtggataccgacg

SEQ ID NO: 64710 - DNA, 20 bp, Artificial Sequence
  sgRNA
  Zp3_3
catcctcaggactaaccgtg

SEQ ID NO: 64711 - DNA, 20 bp, Artificial Sequence
  sgRNA
  Zp3_4
tctcagatagaccatccaca

SEQ ID NO: 64712 - DNA, 20 bp, Artificial Sequence
  sgRNA
  Zp3_5
tcggtatccacggacacccg

SEQ ID NO: 64713 - DNA, 20 bp, Artificial Sequence
  sgRNA
  Zp3_6
actggggtgggagttccacc

SEQ ID NO: 64714 - DNA, 20 bp, Artificial Sequence
  sgRNA
  Zp3_7
gttgcacgagtgcagcagca

SEQ ID NO: 64715 - DNA, 20 bp, Artificial Sequence
  sgRNA
  Zp3_8
gctgctgcactcgtgcaact

SEQ ID NO: 64716 - DNA, 20 bp, Artificial Sequence
  sgRNA
  Zp3_9
ctccccctatcacttcatcg

SEQ ID NO: 64717 - DNA, 20 bp, Artificial Sequence
  sgRNA
  Zp3_10
gtgaaggcgtggccacgcag

SEQ ID NO: 64718 - DNA, 20 bp, Artificial Sequence
  sgRNA
  Zp3_11
tgaactggagagtctctggc

SEQ ID NO: 64719 - DNA, 20 bp, Artificial Sequence
  sgRNA
  Zp3_12
gcctttccaaggaatatcag

SEQ ID NO: 64720 - DNA, 20 bp, Artificial Sequence
  sgRNA
  Zp3_13
agatccatggaccccgccag

SEQ ID NO: 64721 - DNA, 20 bp, Artificial Sequence
  sgRNA
  Zp3_14
actagcttggaccactggcg

SEQ ID NO: 64722 - DNA, 20 bp, Artificial Sequence
  sgRNA
  Zp3_15
catttcaagtccccagaccc

SEQ ID NO: 64723 - DNA, 20 bp, Artificial Sequence
  sgRNA
  Zp3_16
aactggagagtctctggccg

SEQ ID NO: 64724 - DNA, 20 bp, Artificial Sequence
  sgRNA
  Zp3_17
acaggccactcacagggcga

SEQ ID NO: 64725 - DNA, 20 bp, Artificial Sequence
  sgRNA
  Zp3_18
ggcgttgaacctgaccacgt

SEQ ID NO: 64726 - DNA, 20 bp, Artificial Sequence
  sgRNA
  Zp3_19
gctgacaaccctctgagcca

SEQ ID NO: 64727 - DNA, 20 bp, Artificial Sequence
  sgRNA
  Zp3_20
tagctggcgcgactttgaga

SEQ ID NO: 64728 - DNA, 20 bp, Artificial Sequence
  sgRNA
  Zpld1_1
tcattaggattcaacctaca

SEQ ID NO: 64729 - DNA, 20 bp, Artificial Sequence
  sgRNA
  Zpld1_2
gtgcaagctactaatctgga

SEQ ID NO: 64730 - DNA, 20 bp, Artificial Sequence
  sgRNA
  Zpld1_3
tttccagaagcaccaacacc

SEQ ID NO: 64731 - DNA, 20 bp, Artificial Sequence
  sgRNA
  Zpld1_4
agagacatcagtgtctactg

SEQ ID NO: 64732 - DNA, 20 bp, Artificial Sequence
  sgRNA
  Zpld1_5
tagcgattagagtgagtcca

SEQ ID NO: 64733 - DNA, 20 bp, Artificial Sequence
  sgRNA
  Zpld1_6
atttccagaagtgctctgcg

SEQ ID NO: 64734 - DNA, 20 bp, Artificial Sequence
  sgRNA
  Zpld1_7
gactcactctaatcgctaga

SEQ ID NO: 64735 - DNA, 20 bp, Artificial Sequence
  sgRNA
  Zpld1_8
gatagctgataactgctgga

SEQ ID NO: 64736 - DNA, 20 bp, Artificial Sequence
  sgRNA
  Zpld1_9
actggcccttctacaccgaa

SEQ ID NO: 64737 - DNA, 20 bp, Artificial Sequence
  sgRNA
  Zpld1_10
ctaaatttgtaaagaagccc

SEQ ID NO: 64738 - DNA, 20 bp, Artificial Sequence
  sgRNA
  Zpld1_11
ttattaaccaggtattccaa

SEQ ID NO: 64739 - DNA, 20 bp, Artificial Sequence
  sgRNA
  Zpld1_12
agatccctttcggtgtagaa

SEQ ID NO: 64740 - DNA, 20 bp, Artificial Sequence
  sgRNA
  Zpld1_13
cagctctgcagagtttcgtg

SEQ ID NO: 64741 - DNA, 20 bp, Artificial Sequence
  sgRNA
  Zpld1_14
ggaatccaaatgatgatact

SEQ ID NO: 64742 - DNA, 20 bp, Artificial Sequence
  sgRNA
  Zpld1_15
tcaagggtaatcctatactc

SEQ ID NO: 64743 - DNA, 20 bp, Artificial Sequence
  sgRNA
  Zpld1_16
aatgctaccacagtacagat

SEQ ID NO: 64744 - DNA, 20 bp, Artificial Sequence
  sgRNA
  Zpld1_17
ccaagctgtgaattgttggt

SEQ ID NO: 64745 - DNA, 20 bp, Artificial Sequence
  sgRNA
  Zpld1_18
gataattaattgctccctgt

SEQ ID NO: 64746 - DNA, 20 bp, Artificial Sequence
  sgRNA
  Zpld1_19
gattcttgtgtttcacaaaa

SEQ ID NO: 64747 - DNA, 20 bp, Artificial Sequence
  sgRNA
  Zpld1_20
aatatttcctatctgtactg

SEQ ID NO: 64748 - DNA, 20 bp, Artificial Sequence
  sgRNA
  NTC_1
gtttcggtcgggccgaaaca

SEQ ID NO: 64749 - DNA, 20 bp, Artificial Sequence
  sgRNA
  NTC_2
gggatcattcgataccgtcg

SEQ ID NO: 64750 - DNA, 20 bp, Artificial Sequence
  sgRNA
  NTC_3
ttagcttacgtcgacgctgt

SEQ ID NO: 64751 - DNA, 20 bp, Artificial Sequence
  sgRNA
  NTC_4
gcgactaggatgaccgtcgc

SEQ ID NO: 64752 - DNA, 20 bp, Artificial Sequence
  sgRNA
  NTC_5
tcgcaaatgcgaaacacgtc

SEQ ID NO: 64753 - DNA, 20 bp, Artificial Sequence
  sgRNA
  NTC_6
gtgcgatcacacgtagttat

SEQ ID NO: 64754 - DNA, 20 bp, Artificial Sequence
  sgRNA
  NTC_7
acttgcgcgttaccgatcga

SEQ ID NO: 64755 - DNA, 20 bp, Artificial Sequence
  sgRNA
  NTC_8
agggcgtcatcgttcgaaac

SEQ ID NO: 64756 - DNA, 20 bp, Artificial Sequence
  sgRNA
  NTC_9
gatgctcgttcacgtccccg

SEQ ID NO: 64757 - DNA, 20 bp, Artificial Sequence
  sgRNA
  NTC_10
cgtgcggggagtcgcgagat

SEQ ID NO: 64758 - DNA, 20 bp, Artificial Sequence
  sgRNA
  NTC_11
cgggtgcgtttaacgaaccg

SEQ ID NO: 64759 - DNA, 20 bp, Artificial Sequence
  sgRNA
  NTC_12
tatcgagatttcgttccgct

SEQ ID NO: 64760 - DNA, 20 bp, Artificial Sequence
  sgRNA
  NTC_13
gtcggctaggtacttcgcat

SEQ ID NO: 64761 - DNA, 20 bp, Artificial Sequence
  sgRNA
  NTC_14
aatcggcgtctatcgcatgc

SEQ ID NO: 64762 - DNA, 20 bp, Artificial Sequence
  sgRNA
  NTC_15
gtcaatgctcgcttacgcgt

SEQ ID NO: 64763 - DNA, 20 bp, Artificial Sequence
  sgRNA
  NTC_16
gtgcgcacgtcacttacgtc

SEQ ID NO: 64764 - DNA, 20 bp, Artificial Sequence
  sgRNA
  NTC_17
aatttgatgtcgcgtcgtaa

SEQ ID NO: 64765 - DNA, 20 bp, Artificial Sequence
  sgRNA
  NTC_18
gtactaagacttaccgatcg

SEQ ID NO: 64766 - DNA, 20 bp, Artificial Sequence
  sgRNA
  NTC_19
gtattcacggcacacacgcg

SEQ ID NO: 64767 - DNA, 20 bp, Artificial Sequence
  sgRNA
  NTC_20
gggcgcaagacttcgcacta

SEQ ID NO: 64768 - DNA, 20 bp, Artificial Sequence
  sgRNA
  NTC_21
cgttaattcagcgtcgtatc

SEQ ID NO: 64769 - DNA, 20 bp, Artificial Sequence
  sgRNA
  NTC_22
tgagcagacactatcgttcc

SEQ ID NO: 64770 - DNA, 20 bp, Artificial Sequence
  sgRNA
  NTC_23
gcgcgggctcggatcgtatg

SEQ ID NO: 64771 - DNA, 20 bp, Artificial Sequence
  sgRNA
  NTC_24
gcgttcgagtaccgtgcgag

SEQ ID NO: 64772 - DNA, 20 bp, Artificial Sequence
  sgRNA
  NTC_25
tgatacgatcagtccgacgt

SEQ ID NO: 64773 - DNA, 20 bp, Artificial Sequence
  sgRNA
  NTC_26
cggtcgggattatgtcgtag

SEQ ID NO: 64774 - DNA, 20 bp, Artificial Sequence
  sgRNA
  NTC_27
agaggtcgtatcgagctatc

SEQ ID NO: 64775 - DNA, 20 bp, Artificial Sequence
  sgRNA
  NTC_28
tttcgatctagtccgcccca

SEQ ID NO: 64776 - DNA, 20 bp, Artificial Sequence
  sgRNA
  NTC_29
atggtcggcgtaccgcgcga

SEQ ID NO: 64777 - DNA, 20 bp, Artificial Sequence
  sgRNA
  NTC_30
acaacaacgcgcgcgaacgt

SEQ ID NO: 64778 - DNA, 20 bp, Artificial Sequence
  sgRNA
  NTC_31
ttcgtatggctcgacccctc

SEQ ID NO: 64779 - DNA, 20 bp, Artificial Sequence
  sgRNA
  NTC_32
gtcgcggggttacgcgcttt

SEQ ID NO: 64780 - DNA, 20 bp, Artificial Sequence
  sgRNA
  NTC_33
gtgcggcacgcgttgcgttt

SEQ ID NO: 64781 - DNA, 20 bp, Artificial Sequence
  sgRNA
  NTC_34
tcgatacggcgccagtaaac

SEQ ID NO: 64782 - DNA, 20 bp, Artificial Sequence
  sgRNA
  NTC_35
tgcgggaggatacgacacct

SEQ ID NO: 64783 - DNA, 20 bp, Artificial Sequence
  sgRNA
  NTC_36
gatcggctagaaccgagaat

SEQ ID NO: 64784 - DNA, 20 bp, Artificial Sequence
  sgRNA
  NTC_37
tgcgtaaatggtcgacgccg

SEQ ID NO: 64785 - DNA, 20 bp, Artificial Sequence
  sgRNA
  NTC_38
aacgcacagtgttacgcgtc

SEQ ID NO: 64786 - DNA, 20 bp, Artificial Sequence
  sgRNA
  NTC_39
ggaatggcgcgccaactata

SEQ ID NO: 64787 - DNA, 20 bp, Artificial Sequence
  sgRNA
  NTC_40
tggtatctatgcgccgacta

SEQ ID NO: 64788 - DNA, 20 bp, Artificial Sequence
  sgRNA
  NTC_41
aattagtcgcgcagcgatta

SEQ ID NO: 64789 - DNA, 20 bp, Artificial Sequence
  sgRNA
  NTC_42
gacgacgcatcgtagtgagc

SEQ ID NO: 64790 - DNA, 20 bp, Artificial Sequence
  sgRNA
  NTC_43
aacgctgaagcgtcgagttt

SEQ ID NO: 64791 - DNA, 20 bp, Artificial Sequence
  sgRNA
  NTC_44
tcgctgtgcgcgcaccgcga

SEQ ID NO: 64792 - DNA, 20 bp, Artificial Sequence
  sgRNA
  NTC_45
acgacgcgaagcttgtatcg

SEQ ID NO: 64793 - DNA, 20 bp, Artificial Sequence
  sgRNA
  NTC_46
cgtacgtgatttgcgtcaaa

SEQ ID NO: 64794 - DNA, 20 bp, Artificial Sequence
  sgRNA
  NTC_47
ggagtttgcatcgtcgccca

SEQ ID NO: 64795 - DNA, 20 bp, Artificial Sequence
  sgRNA
  NTC_48
ataattgagttccacaaccg

SEQ ID NO: 64796 - DNA, 20 bp, Artificial Sequence
  sgRNA
  NTC_49
gatacgtaggtgcgaagatc

SEQ ID NO: 64797 - DNA, 20 bp, Artificial Sequence
  sgRNA
  NTC_50
gtaaacgatggtccgtcgcg

SEQ ID NO: 64798 - DNA, 20 bp, Artificial Sequence
  sgRNA
  NTC_51
actagttcttgccgcgtacc

SEQ ID NO: 64799 - DNA, 20 bp, Artificial Sequence
  sgRNA
  NTC_52
gctggcttcggcgacgcgta

SEQ ID NO: 64800 - DNA, 20 bp, Artificial Sequence
  sgRNA
  NTC_53
ggcgataatttcatcgacgc

SEQ ID NO: 64801 - DNA, 20 bp, Artificial Sequence
  sgRNA
  NTC_54
cggtatcgatacgagtttcg

SEQ ID NO: 64802 - DNA, 20 bp, Artificial Sequence
  sgRNA
  NTC_55
ctcgggaggctccgtataaa

SEQ ID NO: 64803 - DNA, 20 bp, Artificial Sequence
  sgRNA
  NTC_56
cgcgcgagtggtctcgaaat

SEQ ID NO: 64804 - DNA, 20 bp, Artificial Sequence
  sgRNA
  NTC_57
catgcgaatgttgacgtctc

SEQ ID NO: 64805 - DNA, 20 bp, Artificial Sequence
  sgRNA
  NTC_58
tagtatctgggttgcgcata

SEQ ID NO: 64806 - DNA, 20 bp, Artificial Sequence
  sgRNA
  NTC_59
gttgttgggtctgacgcgag

SEQ ID NO: 64807 - DNA, 20 bp, Artificial Sequence
  sgRNA
  NTC_60
acggaaggggatttcgattc

SEQ ID NO: 64808 - DNA, 20 bp, Artificial Sequence
  sgRNA
  NTC_61
atgcgtggtctagccgaata

SEQ ID NO: 64809 - DNA, 20 bp, Artificial Sequence
  sgRNA
  NTC_62
agcagcttgggacgcgctcg

SEQ ID NO: 64810 - DNA, 20 bp, Artificial Sequence
  sgRNA
  NTC_63
cgaactacgcgctcgtcatc

SEQ ID NO: 64811 - DNA, 20 bp, Artificial Sequence
  sgRNA
  NTC_64
gcgcgttcgcggaacattgt

SEQ ID NO: 64812 - DNA, 20 bp, Artificial Sequence
  sgRNA
  NTC_65
aagctctggtacgcgacgat

SEQ ID NO: 64813 - DNA, 20 bp, Artificial Sequence
  sgRNA
  NTC_66
atcgtgcttcattcgtatgc

SEQ ID NO: 64814 - DNA, 20 bp, Artificial Sequence
  sgRNA
  NTC_67
ctacggattatacacgtagt

SEQ ID NO: 64815 - DNA, 20 bp, Artificial Sequence
  sgRNA
  NTC_68
tagggggattcgcgtgacga

SEQ ID NO: 64816 - DNA, 20 bp, Artificial Sequence
  sgRNA
  NTC_69
gtagagcgtcgacgcatgcg

SEQ ID NO: 64817 - DNA, 20 bp, Artificial Sequence
  sgRNA
  NTC_70
ggattaagctcgatcgtacc

SEQ ID NO: 64818 - DNA, 20 bp, Artificial Sequence
  sgRNA
  NTC_71
acgtggagtataccgaacga

SEQ ID NO: 64819 - DNA, 20 bp, Artificial Sequence
  sgRNA
  NTC_72
gcgtttacggcgctcaattc

SEQ ID NO: 64820 - DNA, 20 bp, Artificial Sequence
  sgRNA
  NTC_73
cgagggtattcgttatcaac

SEQ ID NO: 64821 - DNA, 20 bp, Artificial Sequence
  sgRNA
  NTC_74
tgacgagtcggtcgtaccgt

SEQ ID NO: 64822 - DNA, 20 bp, Artificial Sequence
  sgRNA
  NTC_75
cattgagcgacgaacaccaa

SEQ ID NO: 64823 - DNA, 20 bp, Artificial Sequence
  sgRNA
  NTC_76
atcgcgaaatcgaccagaat

SEQ ID NO: 64824 - DNA, 20 bp, Artificial Sequence
  sgRNA
  NTC_77
tcggctattgaccacgcgat

SEQ ID NO: 64825 - DNA, 20 bp, Artificial Sequence
  sgRNA
  NTC_78
gatgtacggggataagcgtc

SEQ ID NO: 64826 - DNA, 20 bp, Artificial Sequence
  sgRNA
  NTC_79
tcgtaagtacgcatcgctcc

SEQ ID NO: 64827 - DNA, 20 bp, Artificial Sequence
  sgRNA
  NTC_80
tcaaatagctgttacgcgaa

SEQ ID NO: 64828 - DNA, 20 bp, Artificial Sequence
  sgRNA
  NTC_81
ttctggcagtagcgccaacg

SEQ ID NO: 64829 - DNA, 20 bp, Artificial Sequence
  sgRNA
  NTC_82
aacgcgcagaggcgcgcgat

SEQ ID NO: 64830 - DNA, 20 bp, Artificial Sequence
  sgRNA
  NTC_83
gtagcaatgcacttcgcccc

SEQ ID NO: 64831 - DNA, 20 bp, Artificial Sequence
  sgRNA
  NTC_84
gtgatctgttcacgcgcgta

SEQ ID NO: 64832 - DNA, 20 bp, Artificial Sequence
  sgRNA
  NTC_85
ctacgtctctacgagcgatc

SEQ ID NO: 64833 - DNA, 20 bp, Artificial Sequence
  sgRNA
  NTC_86
taatcgcgttcgtagcgacc

SEQ ID NO: 64834 - DNA, 20 bp, Artificial Sequence
  sgRNA
  NTC_87
tacgctaaaagtcgtccaac

SEQ ID NO: 64835 - DNA, 20 bp, Artificial Sequence
  sgRNA
  NTC_88
cggaacgactcgtcattgcg

SEQ ID NO: 64836 - DNA, 20 bp, Artificial Sequence
  sgRNA
  NTC_89
tgcgttggacgcgacgtcgc

SEQ ID NO: 64837 - DNA, 20 bp, Artificial Sequence
  sgRNA
  NTC_90
gctttggtcacgtccgacca

SEQ ID NO: 64838 - DNA, 20 bp, Artificial Sequence
  sgRNA
  NTC_91
gaactacatcaatccgtgta

SEQ ID NO: 64839 - DNA, 20 bp, Artificial Sequence
  sgRNA
  NTC_92
ttgcgttgcatcgcgccact

SEQ ID NO: 64840 - DNA, 20 bp, Artificial Sequence
  sgRNA
  NTC_93
cacgacacgtcagactcccg

SEQ ID NO: 64841 - DNA, 20 bp, Artificial Sequence
  sgRNA
  NTC_94
gacgaattgggcgtccgcgt

SEQ ID NO: 64842 - DNA, 20 bp, Artificial Sequence
  sgRNA
  NTC_95
tcgggatacgacacgtcgta

SEQ ID NO: 64843 - DNA, 20 bp, Artificial Sequence
  sgRNA
  NTC_96
ctctgaaaggggcgcacgac

SEQ ID NO: 64844 - DNA, 20 bp, Artificial Sequence
  sgRNA
  NTC_97
ggcgcgctcgcgcctaatta

SEQ ID NO: 64845 - DNA, 20 bp, Artificial Sequence
  sgRNA
  NTC_98
tctaacgtcgggaccgtgtc

SEQ ID NO: 64846 - DNA, 20 bp, Artificial Sequence
  sgRNA
  NTC_99
gcatattagtgccgtactaa

SEQ ID NO: 64847 - DNA, 20 bp, Artificial Sequence
  sgRNA
  NTC_100
gtacggttctttatcgcgac

SEQ ID NO: 64848 - DNA, 20 bp, Artificial Sequence
  sgRNA
  NTC_101
ggggtgcgaatcgtgtcgat

SEQ ID NO: 64849 - DNA, 20 bp, Artificial Sequence
  sgRNA
  NTC_102
gcgctactcgtaagtcgatc

SEQ ID NO: 64850 - DNA, 20 bp, Artificial Sequence
  sgRNA
  NTC_103
gttgcgaattagccgccaag

SEQ ID NO: 64851 - DNA, 20 bp, Artificial Sequence
  sgRNA
  NTC_104
cggagcgttagacacgcccg

SEQ ID NO: 64852 - DNA, 20 bp, Artificial Sequence
  sgRNA
  NTC_105
gggcgtgacgcaaacccgta

SEQ ID NO: 64853 - DNA, 20 bp, Artificial Sequence
  sgRNA
  NTC_106
cgataacgtcgaatcgagac

SEQ ID NO: 64854 - DNA, 20 bp, Artificial Sequence
  sgRNA
  NTC_107
ttgcttcgctaaccgcgcca

SEQ ID NO: 64855 - DNA, 20 bp, Artificial Sequence
  sgRNA
  NTC_108
cttatatgtcgtcgaccccg

SEQ ID NO: 64856 - DNA, 20 bp, Artificial Sequence
  sgRNA
  NTC_109
cgtttcgattcgccgaccag

SEQ ID NO: 64857 - DNA, 20 bp, Artificial Sequence
  sgRNA
  NTC_110
gtacggtatttcgaacccgt

SEQ ID NO: 64858 - DNA, 20 bp, Artificial Sequence
  sgRNA
  NTC_111
caaaagtgatcactcgcgag

SEQ ID NO: 64859 - DNA, 20 bp, Artificial Sequence
  sgRNA
  NTC_112
gaggcgttgacgaaaccgac

SEQ ID NO: 64860 - DNA, 20 bp, Artificial Sequence
  sgRNA
  NTC_113
cgtagcgtatcgacaatttg

SEQ ID NO: 64861 - DNA, 20 bp, Artificial Sequence
  sgRNA
  NTC_114
gcacgggctgaacgaatatt

SEQ ID NO: 64862 - DNA, 20 bp, Artificial Sequence
  sgRNA
  NTC_115
gctcgacgacagtcgctatc

SEQ ID NO: 64863 - DNA, 20 bp, Artificial Sequence
  sgRNA
  NTC_116
gggtagcgacgacctatacg

SEQ ID NO: 64864 - DNA, 20 bp, Artificial Sequence
  sgRNA
  NTC_117
gtcggtcgcgcgttgctatt

SEQ ID NO: 64865 - DNA, 20 bp, Artificial Sequence
  sgRNA
  NTC_118
aagatcggttcgcgtgacga

SEQ ID NO: 64866 - DNA, 20 bp, Artificial Sequence
  sgRNA
  NTC_119
ctcggtcataattacgcact

SEQ ID NO: 64867 - DNA, 20 bp, Artificial Sequence
  sgRNA
  NTC_120
atatctaggctgaccgcgtt

SEQ ID NO: 64868 - DNA, 20 bp, Artificial Sequence
  sgRNA
  NTC_121
agtatctggacgacgatcgt

SEQ ID NO: 64869 - DNA, 20 bp, Artificial Sequence
  sgRNA
  NTC_122
acgacttcgggcttcgattt

SEQ ID NO: 64870 - DNA, 20 bp, Artificial Sequence
  sgRNA
  NTC_123
gcggcagggggacgttctta

SEQ ID NO: 64871 - DNA, 20 bp, Artificial Sequence
  sgRNA
  NTC_124
gcgagtatgagatccgctga

SEQ ID NO: 64872 - DNA, 20 bp, Artificial Sequence
  sgRNA
  NTC_125
aatcgcgattggacgattaa

SEQ ID NO: 64873 - DNA, 20 bp, Artificial Sequence
  sgRNA
  NTC_126
cgcgcgaggagtaattcgac

SEQ ID NO: 64874 - DNA, 20 bp, Artificial Sequence
  sgRNA
  NTC_127
ctactatagcgcgctcttta

SEQ ID NO: 64875 - DNA, 20 bp, Artificial Sequence
  sgRNA
  NTC_128
tgctttgtcgcgttcgaacc

SEQ ID NO: 64876 - DNA, 20 bp, Artificial Sequence
  sgRNA
  NTC_129
gtgttcggcatactcgccgt

SEQ ID NO: 64877 - DNA, 20 bp, Artificial Sequence
  sgRNA
  NTC_130
cgtacattgatccgcgcacc

SEQ ID NO: 64878 - DNA, 20 bp, Artificial Sequence
  sgRNA
  NTC_131
gcgcgtttcgatacgccttg

SEQ ID NO: 64879 - DNA, 20 bp, Artificial Sequence
  sgRNA
  NTC_132
tcagcacgaatacgccacgt

SEQ ID NO: 64880 - DNA, 20 bp, Artificial Sequence
  sgRNA
  NTC_133
atcgcttaatcatcgcctac

SEQ ID NO: 64881 - DNA, 20 bp, Artificial Sequence
  sgRNA
  NTC_134
gcatgagggctacgacgccg

SEQ ID NO: 64882 - DNA, 20 bp, Artificial Sequence
  sgRNA
  NTC_135
gtttcactagatcgcgcgct

SEQ ID NO: 64883 - DNA, 20 bp, Artificial Sequence
  sgRNA
  NTC_136
gtcgtacgtaagtcccaaat

SEQ ID NO: 64884 - DNA, 20 bp, Artificial Sequence
  sgRNA
  NTC_137
ggactagtcggcgcgctaag

SEQ ID NO: 64885 - DNA, 20 bp, Artificial Sequence
  sgRNA
  NTC_138
atatgtgtcacttagcgcgc

SEQ ID NO: 64886 - DNA, 20 bp, Artificial Sequence
  sgRNA
  NTC_139
tatttcggtgtagcgcgata

SEQ ID NO: 64887 - DNA, 20 bp, Artificial Sequence
  sgRNA
  NTC_140
ttatgggcaacgcgcgatcc

SEQ ID NO: 64888 - DNA, 20 bp, Artificial Sequence
  sgRNA
  NTC_141
gacggtgtcgacgtaaacgt

SEQ ID NO: 64889 - DNA, 20 bp, Artificial Sequence
  sgRNA
  NTC_142
cgtctttggcgaccgccgac

SEQ ID NO: 64890 - DNA, 20 bp, Artificial Sequence
  sgRNA
  NTC_143
gagcgttgttatcgactacg

SEQ ID NO: 64891 - DNA, 20 bp, Artificial Sequence
  sgRNA
  NTC_144
cttgagactacgcgaaaaaa

SEQ ID NO: 64892 - DNA, 20 bp, Artificial Sequence
  sgRNA
  NTC_145
cggcgactagtgtattcgac

SEQ ID NO: 64893 - DNA, 20 bp, Artificial Sequence
  sgRNA
  NTC_146
ttgtacggcatacacgcgat

SEQ ID NO: 64894 - DNA, 20 bp, Artificial Sequence
  sgRNA
  NTC_147
ctcgatcgagtgattgccgc

SEQ ID NO: 64895 - DNA, 20 bp, Artificial Sequence
  sgRNA
  NTC_148
agtgcagtagcgtcgcacct

SEQ ID NO: 64896 - DNA, 20 bp, Artificial Sequence
  sgRNA
  NTC_149
atcgtacggacgtcgcgttt

SEQ ID NO: 64897 - DNA, 20 bp, Artificial Sequence
  sgRNA
  NTC_150
acggattgctacgccgcatt

SEQ ID NO: 64898 - DNA, 20 bp, Artificial Sequence
  sgRNA
  NTC_151
tgcaatactgcgtacgtcta

SEQ ID NO: 64899 - DNA, 20 bp, Artificial Sequence
  sgRNA
  NTC_152
gtcgatcgtagtagcgtcag

SEQ ID NO: 64900 - DNA, 20 bp, Artificial Sequence
  sgRNA
  NTC_153
gctaattacaaatgcgtacc

SEQ ID NO: 64901 - DNA, 20 bp, Artificial Sequence
  sgRNA
  NTC_154
ggggttgactttgtcgcgtc

SEQ ID NO: 64902 - DNA, 20 bp, Artificial Sequence
  sgRNA
  NTC_155
tgcggtatggcgcgccgtac

SEQ ID NO: 64903 - DNA, 20 bp, Artificial Sequence
  sgRNA
  NTC_156
gcgcttgcgaaaaccaattc

SEQ ID NO: 64904 - DNA, 20 bp, Artificial Sequence
  sgRNA
  NTC_157
caaaactaacacgcgcgtgt

SEQ ID NO: 64905 - DNA, 20 bp, Artificial Sequence
  sgRNA
  NTC_158
gcggattcaacgcattgaat

SEQ ID NO: 64906 - DNA, 20 bp, Artificial Sequence
  sgRNA
  NTC_159
cgtcgctaatttcgaagcat

SEQ ID NO: 64907 - DNA, 20 bp, Artificial Sequence
  sgRNA
  NTC_160
tcggaatgttcgcgtagtcg

SEQ ID NO: 64908 - DNA, 20 bp, Artificial Sequence
  sgRNA
  NTC_161
atgtcgcggatcctcgatgt

SEQ ID NO: 64909 - DNA, 20 bp, Artificial Sequence
  sgRNA
  NTC_162
ggttacgtcgatacacagcg

SEQ ID NO: 64910 - DNA, 20 bp, Artificial Sequence
  sgRNA
  NTC_163
gctaggcaagatacgcatcg

SEQ ID NO: 64911 - DNA, 20 bp, Artificial Sequence
  sgRNA
  NTC_164
attgcgctggtacgcacctc

SEQ ID NO: 64912 - DNA, 20 bp, Artificial Sequence
  sgRNA
  NTC_165
tggttcggtggctcgacatg

SEQ ID NO: 64913 - DNA, 20 bp, Artificial Sequence
  sgRNA
  NTC_166
cgtcgacgtacgtcttacca

SEQ ID NO: 64914 - DNA, 20 bp, Artificial Sequence
  sgRNA
  NTC_167
tctcggacaaagcacgcatc

SEQ ID NO: 64915 - DNA, 20 bp, Artificial Sequence
  sgRNA
  NTC_168
ggcacaattgtccgcgctta

SEQ ID NO: 64916 - DNA, 20 bp, Artificial Sequence
  sgRNA
  NTC_169
tatcactacacgccgacgcg

SEQ ID NO: 64917 - DNA, 20 bp, Artificial Sequence
  sgRNA
  NTC_170
gcggttaattggcgccgata

SEQ ID NO: 64918 - DNA, 20 bp, Artificial Sequence
  sgRNA
  NTC_171
gacgcaattctacgccaccg

SEQ ID NO: 64919 - DNA, 20 bp, Artificial Sequence
  sgRNA
  NTC_172
gacgcgatgtcgttctcgaa

SEQ ID NO: 64920 - DNA, 20 bp, Artificial Sequence
  sgRNA
  NTC_173
cgaaaggtacgcgccgtgtt

SEQ ID NO: 64921 - DNA, 20 bp, Artificial Sequence
  sgRNA
  NTC_174
tgcgttgaatacacgcgccg

SEQ ID NO: 64922 - DNA, 20 bp, Artificial Sequence
  sgRNA
  NTC_175
aattacgcggcgcatacgta

SEQ ID NO: 64923 - DNA, 20 bp, Artificial Sequence
  sgRNA
  NTC_176
atggttacgcgaaccgtact

SEQ ID NO: 64924 - DNA, 20 bp, Artificial Sequence
  sgRNA
  NTC_177
ttacgcgcgtgtttgcgcaa

SEQ ID NO: 64925 - DNA, 20 bp, Artificial Sequence
  sgRNA
  NTC_178
ttgactcgatggcgtcgtag

SEQ ID NO: 64926 - DNA, 20 bp, Artificial Sequence
  sgRNA
  NTC_179
tgcatcgatcgagtacgacg

SEQ ID NO: 64927 - DNA, 20 bp, Artificial Sequence
  sgRNA
  NTC_180
actcagacattgcgcaccat

SEQ ID NO: 64928 - DNA, 20 bp, Artificial Sequence
  sgRNA
  NTC_181
ttgtcagggcacgttcgatt

SEQ ID NO: 64929 - DNA, 20 bp, Artificial Sequence
  sgRNA
  NTC_182
aaggtcgtcgacgccgatag

SEQ ID NO: 64930 - DNA, 20 bp, Artificial Sequence
  sgRNA
  NTC_183
actcgtcgcgagcgtaataa

SEQ ID NO: 64931 - DNA, 20 bp, Artificial Sequence
  sgRNA
  NTC_184
ctagtgaggcagcgaccgct

SEQ ID NO: 64932 - DNA, 20 bp, Artificial Sequence
  sgRNA
  NTC_185
ctcgcaaggtgttcaacgat

SEQ ID NO: 64933 - DNA, 20 bp, Artificial Sequence
  sgRNA
  NTC_186
tcgtaaggagcgatcgatac

SEQ ID NO: 64934 - DNA, 20 bp, Artificial Sequence
  sgRNA
  NTC_187
cgtcgtctctaatacgaacg

SEQ ID NO: 64935 - DNA, 20 bp, Artificial Sequence
  sgRNA
  NTC_188
tgtacggcgttaagctcgca

SEQ ID NO: 64936 - DNA, 20 bp, Artificial Sequence
  sgRNA
  NTC_189
ggcgcaacgtgataccctta

SEQ ID NO: 64937 - DNA, 20 bp, Artificial Sequence
  sgRNA
  NTC_190
gtgatcacggtgccgactca

SEQ ID NO: 64938 - DNA, 20 bp, Artificial Sequence
  sgRNA
  NTC_191
gggcgaatatgacgttcgtg

SEQ ID NO: 64939 - DNA, 20 bp, Artificial Sequence
  sgRNA
  NTC_192
cattggattattcccgacga

SEQ ID NO: 64940 - DNA, 20 bp, Artificial Sequence
  sgRNA
  NTC_193
acggcagtttcatgctcgta

SEQ ID NO: 64941 - DNA, 20 bp, Artificial Sequence
  sgRNA
  NTC_194
ggtatcgtacgctctcgtaa

SEQ ID NO: 64942 - DNA, 20 bp, Artificial Sequence
  sgRNA
  NTC_195
aatttcgttgcgtacgctag

SEQ ID NO: 64943 - DNA, 20 bp, Artificial Sequence
  sgRNA
  NTC_196
tcggtcgcgtgcctacgtat

SEQ ID NO: 64944 - DNA, 20 bp, Artificial Sequence
  sgRNA
  NTC_197
gagaaatatttgcgcgcgtt

SEQ ID NO: 64945 - DNA, 20 bp, Artificial Sequence
  sgRNA
  NTC_198
acgttcttaacttccgcgac

SEQ ID NO: 64946 - DNA, 20 bp, Artificial Sequence
  sgRNA
  NTC_199
agcgtagggtcgccgaagcg

SEQ ID NO: 64947 - DNA, 20 bp, Artificial Sequence
  sgRNA
  NTC_200
gcaactgcgtgtacgcgtta

SEQ ID NO: 64948 - DNA, 20 bp, Artificial Sequence
  sgRNA
  NTC_201
ctttctggatacaccgacgc

SEQ ID NO: 64949 - DNA, 20 bp, Artificial Sequence
  sgRNA
  NTC_202
tcgctatcgagcgtatacac

SEQ ID NO: 64950 - DNA, 20 bp, Artificial Sequence
  sgRNA
  NTC_203
gggtaatcgtcgtatgcgtc

SEQ ID NO: 64951 - DNA, 20 bp, Artificial Sequence
  sgRNA
  NTC_204
cgagtgtcggatctagattg

SEQ ID NO: 64952 - DNA, 20 bp, Artificial Sequence
  sgRNA
  NTC_205
acgtcatacgttagcgaatt

SEQ ID NO: 64953 - DNA, 20 bp, Artificial Sequence
  sgRNA
  NTC_206
aatcgagcgttagccccgtt

SEQ ID NO: 64954 - DNA, 20 bp, Artificial Sequence
  sgRNA
  NTC_207
gtatggactcgcgcgaagtc

SEQ ID NO: 64955 - DNA, 20 bp, Artificial Sequence
  sgRNA
  NTC_208
acggagtcggctcttaatct

SEQ ID NO: 64956 - DNA, 20 bp, Artificial Sequence
  sgRNA
  NTC_209
cgaagttcggactccgactg

SEQ ID NO: 64957 - DNA, 20 bp, Artificial Sequence
  sgRNA
  NTC_210
cttaagcggcgactagacgc

SEQ ID NO: 64958 - DNA, 20 bp, Artificial Sequence
  sgRNA
  NTC_211
agctttattgtgccgatacg

SEQ ID NO: 64959 - DNA, 20 bp, Artificial Sequence
  sgRNA
  NTC_212
acatcggtggcgtaagcgta

SEQ ID NO: 64960 - DNA, 20 bp, Artificial Sequence
  sgRNA
  NTC_213
gctcgtgattcgccttgtac

SEQ ID NO: 64961 - DNA, 20 bp, Artificial Sequence
  sgRNA
  NTC_214
cgtgaacgtgaaccgtcgta

SEQ ID NO: 64962 - DNA, 20 bp, Artificial Sequence
  sgRNA
  NTC_215
cgcgcgtcggcatgctacgt

SEQ ID NO: 64963 - DNA, 20 bp, Artificial Sequence
  sgRNA
  NTC_216
aattcgttcggcacgctgcg

SEQ ID NO: 64964 - DNA, 20 bp, Artificial Sequence
  sgRNA
  NTC_217
cacgtcgcgcgcaaatgcga

SEQ ID NO: 64965 - DNA, 20 bp, Artificial Sequence
  sgRNA
  NTC_218
cataacgctggcgcgcgcta

SEQ ID NO: 64966 - DNA, 20 bp, Artificial Sequence
  sgRNA
  NTC_219
gactatatgagtcgcgctgc

SEQ ID NO: 64967 - DNA, 20 bp, Artificial Sequence
  sgRNA
  NTC_220
agcgtacgggctcttatgac

SEQ ID NO: 64968 - DNA, 20 bp, Artificial Sequence
  sgRNA
  NTC_221
agaacggaagagcgcagtcg

SEQ ID NO: 64969 - DNA, 20 bp, Artificial Sequence
  sgRNA
  NTC_222
cttaagcggacgcaattccg

SEQ ID NO: 64970 - DNA, 20 bp, Artificial Sequence
  sgRNA
  NTC_223
aaggtgggagagtacgcgtc

SEQ ID NO: 64971 - DNA, 20 bp, Artificial Sequence
  sgRNA
  NTC_224
tcggacgaatattccgacac

SEQ ID NO: 64972 - DNA, 20 bp, Artificial Sequence
  sgRNA
  NTC_225
gacgcggttgctttcgcgat

SEQ ID NO: 64973 - DNA, 20 bp, Artificial Sequence
  sgRNA
  NTC_226
agaaattcgagtcgaatccg

SEQ ID NO: 64974 - DNA, 20 bp, Artificial Sequence
  sgRNA
  NTC_227
gcggttagtacgcgatacga

SEQ ID NO: 64975 - DNA, 20 bp, Artificial Sequence
  sgRNA
  NTC_228
tgctgaaaggacttcgtacc

SEQ ID NO: 64976 - DNA, 20 bp, Artificial Sequence
  sgRNA
  NTC_229
tacgagtcgtcgacaagccg

SEQ ID NO: 64977 - DNA, 20 bp, Artificial Sequence
  sgRNA
  NTC_230
aactttagtgtcgcgacgtg

SEQ ID NO: 64978 - DNA, 20 bp, Artificial Sequence
  sgRNA
  NTC_231
gacgctatattccaacgccc

SEQ ID NO: 64979 - DNA, 20 bp, Artificial Sequence
  sgRNA
  NTC_232
acttcggcgtagtccgtcgt

SEQ ID NO: 64980 - DNA, 20 bp, Artificial Sequence
  sgRNA
  NTC_233
gcgttgctaattattacgtt

SEQ ID NO: 64981 - DNA, 20 bp, Artificial Sequence
  sgRNA
  NTC_234
gctcgcgttggccacgacta

SEQ ID NO: 64982 - DNA, 20 bp, Artificial Sequence
  sgRNA
  NTC_235
tgttctgtcgacgatcgact

SEQ ID NO: 64983 - DNA, 20 bp, Artificial Sequence
  sgRNA
  NTC_236
tgggtaacgctcgcgcattc

SEQ ID NO: 64984 - DNA, 20 bp, Artificial Sequence
  sgRNA
  NTC_237
tctcgatattcgatttcgct

SEQ ID NO: 64985 - DNA, 20 bp, Artificial Sequence
  sgRNA
  NTC_238
atggggcggaaccgttacgc

SEQ ID NO: 64986 - DNA, 20 bp, Artificial Sequence
  sgRNA
  NTC_239
ggtcggagtgtgatattgcc

SEQ ID NO: 64987 - DNA, 20 bp, Artificial Sequence
  sgRNA
  NTC_240
aagtgcgatacgcgcgtctc

SEQ ID NO: 64988 - DNA, 20 bp, Artificial Sequence
  sgRNA
  NTC_241
aggttaggggcgcacgactt

SEQ ID NO: 64989 - DNA, 20 bp, Artificial Sequence
  sgRNA
  NTC_242
agtcgtacgctaatctgtcg

SEQ ID NO: 64990 - DNA, 20 bp, Artificial Sequence
  sgRNA
  NTC_243
gattggcgtaacccgtcgct

SEQ ID NO: 64991 - DNA, 20 bp, Artificial Sequence
  sgRNA
  NTC_244
aggcgcgttacgcgtatgtg

SEQ ID NO: 64992 - DNA, 20 bp, Artificial Sequence
  sgRNA
  NTC_245
tcgatgtctagccgcgcctt

SEQ ID NO: 64993 - DNA, 20 bp, Artificial Sequence
  sgRNA
  NTC_246
acgtcaacatagttcgcgtc

SEQ ID NO: 64994 - DNA, 20 bp, Artificial Sequence
  sgRNA
  NTC_247
cgtggctaggcgcaatcgtg

SEQ ID NO: 64995 - DNA, 20 bp, Artificial Sequence
  sgRNA
  NTC_248
gcgcgctacattaataacgt

SEQ ID NO: 64996 - DNA, 20 bp, Artificial Sequence
  sgRNA
  NTC_249
gtgcgcagcgaatccgcgaa

SEQ ID NO: 64997 - DNA, 20 bp, Artificial Sequence
  sgRNA
  NTC_250
ggtacgaaggggcgtacgcg

SEQ ID NO: 64998 - DNA, 20 bp, Artificial Sequence
  sgRNA
  NTC_251
agcgcgcgtctccgcgaaca

SEQ ID NO: 64999 - DNA, 20 bp, Artificial Sequence
  sgRNA
  NTC_252
cgcatttggcgtcgcgagta

SEQ ID NO: 65000 - DNA, 20 bp, Artificial Sequence
  sgRNA
  NTC_253
cacgagtcggtacgttctac

SEQ ID NO: 65001 - DNA, 20 bp, Artificial Sequence
  sgRNA
  NTC_254
gttcgacaggcgccaccgac

SEQ ID NO: 65002 - DNA, 20 bp, Artificial Sequence
  sgRNA
  NTC_255
gattaatcgcgccccgcaca

SEQ ID NO: 65003 - DNA, 20 bp, Artificial Sequence
  sgRNA
  NTC_256
ttatgaacggatatcgaacg

SEQ ID NO: 65004 - DNA, 20 bp, Artificial Sequence
  sgRNA
  NTC_257
catgggctttctatcgcgcg

SEQ ID NO: 65005 - DNA, 20 bp, Artificial Sequence
  sgRNA
  NTC_258
gggacggatatcgacgctac

SEQ ID NO: 65006 - DNA, 20 bp, Artificial Sequence
  sgRNA
  NTC_259
acgtcgggcggaccgtgttt

SEQ ID NO: 65007 - DNA, 20 bp, Artificial Sequence
  sgRNA
  NTC_260
aaactatcgttcgccgaaca

SEQ ID NO: 65008 - DNA, 20 bp, Artificial Sequence
  sgRNA
  NTC_261
agacgcgtataatgcgcgtc

SEQ ID NO: 65009 - DNA, 20 bp, Artificial Sequence
  sgRNA
  NTC_262
tatgggagcgcgacaattcg

SEQ ID NO: 65010 - DNA, 20 bp, Artificial Sequence
  sgRNA
  NTC_263
agttacatcgcaccacgacg

SEQ ID NO: 65011 - DNA, 20 bp, Artificial Sequence
  sgRNA
  NTC_264
acttatacgcgctagcgcgt

SEQ ID NO: 65012 - DNA, 20 bp, Artificial Sequence
  sgRNA
  NTC_265
caacgctgcacgacgttcgc

SEQ ID NO: 65013 - DNA, 20 bp, Artificial Sequence
  sgRNA
  NTC_266
catagaggttataccgacga

SEQ ID NO: 65014 - DNA, 20 bp, Artificial Sequence
  sgRNA
  NTC_267
tcggatattgcgacgcccat

SEQ ID NO: 65015 - DNA, 20 bp, Artificial Sequence
  sgRNA
  NTC_268
cgttgcgatcagatagtcgc

SEQ ID NO: 65016 - DNA, 20 bp, Artificial Sequence
  sgRNA
  NTC_269
tgttaggtttgcgtaacacg

SEQ ID NO: 65017 - DNA, 20 bp, Artificial Sequence
  sgRNA
  NTC_270
ttgcgttatgtaatcgtgaa

SEQ ID NO: 65018 - DNA, 20 bp, Artificial Sequence
  sgRNA
  NTC_271
tgcgactggacgatgcgcct

SEQ ID NO: 65019 - DNA, 20 bp, Artificial Sequence
  sgRNA
  NTC_272
acggttatcgtttacgcaga

SEQ ID NO: 65020 - DNA, 20 bp, Artificial Sequence
  sgRNA
  NTC_273
tcttctcgatcgacgacgtt

SEQ ID NO: 65021 - DNA, 20 bp, Artificial Sequence
  sgRNA
  NTC_274
ggactacggtcgactaatag

SEQ ID NO: 65022 - DNA, 20 bp, Artificial Sequence
  sgRNA
  NTC_275
cgactctcgaacaatcgacg

SEQ ID NO: 65023 - DNA, 20 bp, Artificial Sequence
  sgRNA
  NTC_276
tgcgggtcgacgccttgtat

SEQ ID NO: 65024 - DNA, 20 bp, Artificial Sequence
  sgRNA
  NTC_277
acgactttgcttgcgcgata

SEQ ID NO: 65025 - DNA, 20 bp, Artificial Sequence
  sgRNA
  NTC_278
cgagaagcgggtatcgatag

SEQ ID NO: 65026 - DNA, 20 bp, Artificial Sequence
  sgRNA
  NTC_279
aatactatctcgcgcgaacc

SEQ ID NO: 65027 - DNA, 20 bp, Artificial Sequence
  sgRNA
  NTC_280
taacagggcacgtccgcgta

SEQ ID NO: 65028 - DNA, 20 bp, Artificial Sequence
  sgRNA
  NTC_281
gaatatcgcgaaccattgac

SEQ ID NO: 65029 - DNA, 20 bp, Artificial Sequence
  sgRNA
  NTC_282
ctacgggggacgagtactac

SEQ ID NO: 65030 - DNA, 20 bp, Artificial Sequence
  sgRNA
  NTC_283
gctgcatggatacgcgaaca

SEQ ID NO: 65031 - DNA, 20 bp, Artificial Sequence
  sgRNA
  NTC_284
aggcgtaacgaatatagtcc

SEQ ID NO: 65032 - DNA, 20 bp, Artificial Sequence
  sgRNA
  NTC_285
gtaagtgcgtattacgagtg

SEQ ID NO: 65033 - DNA, 20 bp, Artificial Sequence
  sgRNA
  NTC_286
gaggagtacggtccgattat

SEQ ID NO: 65034 - DNA, 20 bp, Artificial Sequence
  sgRNA
  NTC_287
gctgagtaacggtacgactg

SEQ ID NO: 65035 - DNA, 20 bp, Artificial Sequence
  sgRNA
  NTC_288
gaagggactgttatcgatgt

SEQ ID NO: 65036 - DNA, 20 bp, Artificial Sequence
  sgRNA
  NTC_289
gactcatctgtcgcacgacc

SEQ ID NO: 65037 - DNA, 20 bp, Artificial Sequence
  sgRNA
  NTC_290
aacttggattcgatatatcg

SEQ ID NO: 65038 - DNA, 20 bp, Artificial Sequence
  sgRNA
  NTC_291
ttctgcgagcaattcgacct

SEQ ID NO: 65039 - DNA, 20 bp, Artificial Sequence
  sgRNA
  NTC_292
tatcgcaggagcgtcaaacg

SEQ ID NO: 65040 - DNA, 20 bp, Artificial Sequence
  sgRNA
  NTC_293
tcgagcagtcgagcgccgaa

SEQ ID NO: 65041 - DNA, 20 bp, Artificial Sequence
  sgRNA
  NTC_294
cggagatcggtcgttcctct

SEQ ID NO: 65042 - DNA, 20 bp, Artificial Sequence
  sgRNA
  NTC_295
gacacgaggatatccgaaac

SEQ ID NO: 65043 - DNA, 20 bp, Artificial Sequence
  sgRNA
  NTC_296
ggtcaatctaaaatcgacga

SEQ ID NO: 65044 - DNA, 20 bp, Artificial Sequence
  sgRNA
  NTC_297
gctttacgcgaatattactc

SEQ ID NO: 65045 - DNA, 20 bp, Artificial Sequence
  sgRNA
  NTC_298
gaatcgcggcaccccgttac

SEQ ID NO: 65046 - DNA, 20 bp, Artificial Sequence
  sgRNA
  NTC_299
ttcggtgataatagtccgct

SEQ ID NO: 65047 - DNA, 20 bp, Artificial Sequence
  sgRNA
  NTC_300
tacgtactcgatcgcagcct

SEQ ID NO: 65048 - DNA, 20 bp, Artificial Sequence
  sgRNA
  NTC_301
ggggtcttctcgcgtgatgt

SEQ ID NO: 65049 - DNA, 20 bp, Artificial Sequence
  sgRNA
  NTC_302
acacgtaacgcgaattacgc

SEQ ID NO: 65050 - DNA, 20 bp, Artificial Sequence
  sgRNA
  NTC_303
cgcgaacggtacttacgaaa

SEQ ID NO: 65051 - DNA, 20 bp, Artificial Sequence
  sgRNA
  NTC_304
gcgatacttgcgcgttcacc

SEQ ID NO: 65052 - DNA, 20 bp, Artificial Sequence
  sgRNA
  NTC_305
tatggcgattcgcagaccaa

SEQ ID NO: 65053 - DNA, 20 bp, Artificial Sequence
  sgRNA
  NTC_306
actcgtcaagttacagcgcg

SEQ ID NO: 65054 - DNA, 20 bp, Artificial Sequence
  sgRNA
  NTC_307
cggtgattcgggttacgtta

SEQ ID NO: 65055 - DNA, 20 bp, Artificial Sequence
  sgRNA
  NTC_308
cggcgtttcgcgccgcccat

SEQ ID NO: 65056 - DNA, 20 bp, Artificial Sequence
  sgRNA
  NTC_309
tggcaagtctacaccgcccg

SEQ ID NO: 65057 - DNA, 20 bp, Artificial Sequence
  sgRNA
  NTC_310
agcaacgttcggacctaatc

SEQ ID NO: 65058 - DNA, 20 bp, Artificial Sequence
  sgRNA
  NTC_311
cttacgagattccgcgaacc

SEQ ID NO: 65059 - DNA, 20 bp, Artificial Sequence
  sgRNA
  NTC_312
gttgcgcatttccgaacgat

SEQ ID NO: 65060 - DNA, 20 bp, Artificial Sequence
  sgRNA
  NTC_313
tcgtcgcgacacttgttcca

SEQ ID NO: 65061 - DNA, 20 bp, Artificial Sequence
  sgRNA
  NTC_314
gagtgaacgttagtccgcgc

SEQ ID NO: 65062 - DNA, 20 bp, Artificial Sequence
  sgRNA
  NTC_315
aagtgaatcgttactcgcga

SEQ ID NO: 65063 - DNA, 20 bp, Artificial Sequence
  sgRNA
  NTC_316
tctggcgatacgtccgcgct

SEQ ID NO: 65064 - DNA, 20 bp, Artificial Sequence
  sgRNA
  NTC_317
gtagctaagtcttcgcgctg

SEQ ID NO: 65065 - DNA, 20 bp, Artificial Sequence
  sgRNA
  NTC_318
gttagatcggcgaatccaca

SEQ ID NO: 65066 - DNA, 20 bp, Artificial Sequence
  sgRNA
  NTC_319
gtcggcacgcgtacgtaaaa

SEQ ID NO: 65067 - DNA, 20 bp, Artificial Sequence
  sgRNA
  NTC_320
gcgtacgctggccacgagta

SEQ ID NO: 65068 - DNA, 20 bp, Artificial Sequence
  sgRNA
  NTC_321
catacgagcgcaaatcgcat

SEQ ID NO: 65069 - DNA, 20 bp, Artificial Sequence
  sgRNA
  NTC_322
gacgtacggaatgccgtatc

SEQ ID NO: 65070 - DNA, 20 bp, Artificial Sequence
  sgRNA
  NTC_323
tcgcgtacgtgcgtagtgtt

SEQ ID NO: 65071 - DNA, 20 bp, Artificial Sequence
  sgRNA
  NTC_324
tcgacggcgaacgcagcata

SEQ ID NO: 65072 - DNA, 20 bp, Artificial Sequence
  sgRNA
  NTC_325
cgaacatggcgtgtccgatt

SEQ ID NO: 65073 - DNA, 20 bp, Artificial Sequence
  sgRNA
  NTC_326
gatgacaacgcgaccgtata

SEQ ID NO: 65074 - DNA, 20 bp, Artificial Sequence
  sgRNA
  NTC_327
aacagtcgtatagtacgacg

SEQ ID NO: 65075 - DNA, 20 bp, Artificial Sequence
  sgRNA
  NTC_328
gacgtggcgtcgcgctttcg

SEQ ID NO: 65076 - DNA, 20 bp, Artificial Sequence
  sgRNA
  NTC_329
agttgtcgatcgcacgtcct

SEQ ID NO: 65077 - DNA, 20 bp, Artificial Sequence
  sgRNA
  NTC_330
ggatcgaattcgtactatag

SEQ ID NO: 65078 - DNA, 20 bp, Artificial Sequence
  sgRNA
  NTC_331
gtgtaagagttcgctacact

SEQ ID NO: 65079 - DNA, 20 bp, Artificial Sequence
  sgRNA
  NTC_332
gggacgcaactagtgcgttt

SEQ ID NO: 65080 - DNA, 20 bp, Artificial Sequence
  sgRNA
  NTC_333
cgatttggtgtattgacgtc

SEQ ID NO: 65081 - DNA, 20 bp, Artificial Sequence
  sgRNA
  NTC_334
cgattaagacgtgccgtagc

SEQ ID NO: 65082 - DNA, 20 bp, Artificial Sequence
  sgRNA
  NTC_335
ggcaacatcgaaatcgtacg

SEQ ID NO: 65083 - DNA, 20 bp, Artificial Sequence
  sgRNA
  NTC_336
gtctaagagatcgcgatccc

SEQ ID NO: 65084 - DNA, 20 bp, Artificial Sequence
  sgRNA
  NTC_337
gaagtacgatcgatcgatac

SEQ ID NO: 65085 - DNA, 20 bp, Artificial Sequence
  sgRNA
  NTC_338
ggaatcgtgcgtaatgcgac

SEQ ID NO: 65086 - DNA, 20 bp, Artificial Sequence
  sgRNA
  NTC_339
gatggactactccgaccgat

SEQ ID NO: 65087 - DNA, 20 bp, Artificial Sequence
  sgRNA
  NTC_340
tttgtggtcgcgtaagcgcc

SEQ ID NO: 65088 - DNA, 20 bp, Artificial Sequence
  sgRNA
  NTC_341
cgaatatagtcgcacgattg

SEQ ID NO: 65089 - DNA, 20 bp, Artificial Sequence
  sgRNA
  NTC_342
tcgctagatttacgcatacg

SEQ ID NO: 65090 - DNA, 20 bp, Artificial Sequence
  sgRNA
  NTC_343
gacgctataacgttcacacg

SEQ ID NO: 65091 - DNA, 20 bp, Artificial Sequence
  sgRNA
  NTC_344
cgtgataatggcgctatatc

SEQ ID NO: 65092 - DNA, 20 bp, Artificial Sequence
  sgRNA
  NTC_345
taaacggtcgcgcctcatta

SEQ ID NO: 65093 - DNA, 20 bp, Artificial Sequence
  sgRNA
  NTC_346
ttggcgatcacgatcgtttg

SEQ ID NO: 65094 - DNA, 20 bp, Artificial Sequence
  sgRNA
  NTC_347
gcgaacgttgcgaatcgtcg

SEQ ID NO: 65095 - DNA, 20 bp, Artificial Sequence
  sgRNA
  NTC_348
cttggactcgaccacgaacc

SEQ ID NO: 65096 - DNA, 20 bp, Artificial Sequence
  sgRNA
  NTC_349
gcgacgtaatttcgtatact

SEQ ID NO: 65097 - DNA, 20 bp, Artificial Sequence
  sgRNA
  NTC_350
cgtgctacacggcgtaacct

SEQ ID NO: 65098 - DNA, 20 bp, Artificial Sequence
  sgRNA
  NTC_351
tatagagtaattgtgcgcgc

SEQ ID NO: 65099 - DNA, 20 bp, Artificial Sequence
  sgRNA
  NTC_352
ggtaatcgtggccacgcacg

SEQ ID NO: 65100 - DNA, 20 bp, Artificial Sequence
  sgRNA
  NTC_353
cgcgcgtatgtgtcgcaccg

SEQ ID NO: 65101 - DNA, 20 bp, Artificial Sequence
  sgRNA
  NTC_354
acgagtgctttatgcgccaa

SEQ ID NO: 65102 - DNA, 20 bp, Artificial Sequence
  sgRNA
  NTC_355
gcgagtaaagcactacgatg

SEQ ID NO: 65103 - DNA, 20 bp, Artificial Sequence
  sgRNA
  NTC_356
tcgtcgagagttcgtaaaca

SEQ ID NO: 65104 - DNA, 20 bp, Artificial Sequence
  sgRNA
  NTC_357
tatcggataatccgacatac

SEQ ID NO: 65105 - DNA, 20 bp, Artificial Sequence
  sgRNA
  NTC_358
attggtggtgcatcgcattc

SEQ ID NO: 65106 - DNA, 20 bp, Artificial Sequence
  sgRNA
  NTC_359
tagattcgacgtacctccag

SEQ ID NO: 65107 - DNA, 20 bp, Artificial Sequence
  sgRNA
  NTC_360
cgacagcgaaatgtcgtaac

SEQ ID NO: 65108 - DNA, 20 bp, Artificial Sequence
  sgRNA
  NTC_361
cggaatcatcgaccgcgtag

SEQ ID NO: 65109 - DNA, 20 bp, Artificial Sequence
  sgRNA
  NTC_362
ttggaggacgcgttcgagtg

SEQ ID NO: 65110 - DNA, 20 bp, Artificial Sequence
  sgRNA
  NTC_363
cacgacggatcacgcatccc

SEQ ID NO: 65111 - DNA, 20 bp, Artificial Sequence
  sgRNA
  NTC_364
tggtgagcgcatgacgtacg

SEQ ID NO: 65112 - DNA, 20 bp, Artificial Sequence
  sgRNA
  NTC_365
aggaatagtcgcacgacgtg

SEQ ID NO: 65113 - DNA, 20 bp, Artificial Sequence
  sgRNA
  NTC_366
gtgctttaagcgttccgcgt

SEQ ID NO: 65114 - DNA, 20 bp, Artificial Sequence
  sgRNA
  NTC_367
tacaactaatacgcgcttag

SEQ ID NO: 65115 - DNA, 20 bp, Artificial Sequence
  sgRNA
  NTC_368
cgcatgacaagtacctcgtc

SEQ ID NO: 65116 - DNA, 20 bp, Artificial Sequence
  sgRNA
  NTC_369
tagaacaagcgatccgcgtc

SEQ ID NO: 65117 - DNA, 20 bp, Artificial Sequence
  sgRNA
  NTC_370
gtacgggattgtgatgcgta

SEQ ID NO: 65118 - DNA, 20 bp, Artificial Sequence
  sgRNA
  NTC_371
tcgcggatacgcgttgctcc

SEQ ID NO: 65119 - DNA, 20 bp, Artificial Sequence
  sgRNA
  NTC_372
ctatcgaacgaacgctactc

SEQ ID NO: 65120 - DNA, 20 bp, Artificial Sequence
  sgRNA
  NTC_373
ctggcgagagcactcgtatc

SEQ ID NO: 65121 - DNA, 20 bp, Artificial Sequence
  sgRNA
  NTC_374
gcgagttcgtcaacgtaaat

SEQ ID NO: 65122 - DNA, 20 bp, Artificial Sequence
  sgRNA
  NTC_375
tttacatgcggcgacgttcg

SEQ ID NO: 65123 - DNA, 20 bp, Artificial Sequence
  sgRNA
  NTC_376
ctcggtcgaggcgtagtccg

SEQ ID NO: 65124 - DNA, 20 bp, Artificial Sequence
  sgRNA
  NTC_377
gacttcacgaagcgtcaatt

SEQ ID NO: 65125 - DNA, 20 bp, Artificial Sequence
  sgRNA
  NTC_378
ttagcggacaacttgacgtt

SEQ ID NO: 65126 - DNA, 20 bp, Artificial Sequence
  sgRNA
  NTC_379
gtcgcgtatcgcagtcgatg

SEQ ID NO: 65127 - DNA, 20 bp, Artificial Sequence
  sgRNA
  NTC_380
gcggtttagtacgatagtac

SEQ ID NO: 65128 - DNA, 20 bp, Artificial Sequence
  sgRNA
  NTC_381
gtgttgaatcacgtcgatcc

SEQ ID NO: 65129 - DNA, 20 bp, Artificial Sequence
  sgRNA
  NTC_382
acgtaaagcgcgcagaccgt

SEQ ID NO: 65130 - DNA, 20 bp, Artificial Sequence
  sgRNA
  NTC_383
gtacactgggaatcgacgta

SEQ ID NO: 65131 - DNA, 20 bp, Artificial Sequence
  sgRNA
  NTC_384
aatcgcgacattaccgtacc

SEQ ID NO: 65132 - DNA, 20 bp, Artificial Sequence
  sgRNA
  NTC_385
acgcggtgatagcgacgtat

SEQ ID NO: 65133 - DNA, 20 bp, Artificial Sequence
  sgRNA
  NTC_386
gcgttatactcgttccgtta

SEQ ID NO: 65134 - DNA, 20 bp, Artificial Sequence
  sgRNA
  NTC_387
gtgtcgacattcgtgcagtc

SEQ ID NO: 65135 - DNA, 20 bp, Artificial Sequence
  sgRNA
  NTC_388
ttagcgtcgaataaatccgc

SEQ ID NO: 65136 - DNA, 20 bp, Artificial Sequence
  sgRNA
  NTC_389
gtctcgtactaagtgcgtag

SEQ ID NO: 65137 - DNA, 20 bp, Artificial Sequence
  sgRNA
  NTC_390
atcgggcgactatagtcgag

SEQ ID NO: 65138 - DNA, 20 bp, Artificial Sequence
  sgRNA
  NTC_391
tgcggcgtgaagttcgacgc

SEQ ID NO: 65139 - DNA, 20 bp, Artificial Sequence
  sgRNA
  NTC_392
ggtagtactgacctcgattc

SEQ ID NO: 65140 - DNA, 20 bp, Artificial Sequence
  sgRNA
  NTC_393
ggcgcgggtcaacgacgttt

SEQ ID NO: 65141 - DNA, 20 bp, Artificial Sequence
  sgRNA
  NTC_394
aaagcacgggggtcgtctaa

SEQ ID NO: 65142 - DNA, 20 bp, Artificial Sequence
  sgRNA
  NTC_395
tcgttgcatcgatacgcttt

SEQ ID NO: 65143 - DNA, 20 bp, Artificial Sequence
  sgRNA
  NTC_396
atgtatacttacgtacgccg

SEQ ID NO: 65144 - DNA, 20 bp, Artificial Sequence
  sgRNA
  NTC_397
atcggcttcggatcgatatt

SEQ ID NO: 65145 - DNA, 20 bp, Artificial Sequence
  sgRNA
  NTC_398
tggcgacgggtcacgtcgca

SEQ ID NO: 65146 - DNA, 20 bp, Artificial Sequence
  sgRNA
  NTC_399
tcgtcggctcgaaaccgatt

SEQ ID NO: 65147 - DNA, 20 bp, Artificial Sequence
  sgRNA
  NTC_400
tatcatacatctcgccgcga

SEQ ID NO: 65148 - DNA, 20 bp, Artificial Sequence
  sgRNA
  NTC_401
ggaatcatcagctacgctac

SEQ ID NO: 65149 - DNA, 20 bp, Artificial Sequence
  sgRNA
  NTC_402
ggtcgtatacggatacgttc

SEQ ID NO: 65150 - DNA, 20 bp, Artificial Sequence
  sgRNA
  NTC_403
taaaacacgactttcgatcg

SEQ ID NO: 65151 - DNA, 20 bp, Artificial Sequence
  sgRNA
  NTC_404
acgggaagctaaaccgatac

SEQ ID NO: 65152 - DNA, 20 bp, Artificial Sequence
  sgRNA
  NTC_405
tgcgactcgatgtacgtcat

SEQ ID NO: 65153 - DNA, 20 bp, Artificial Sequence
  sgRNA
  NTC_406
tttgtcgggcggagtagcga

SEQ ID NO: 65154 - DNA, 20 bp, Artificial Sequence
  sgRNA
  NTC_407
gcgattcgcggtcgaactct

SEQ ID NO: 65155 - DNA, 20 bp, Artificial Sequence
  sgRNA
  NTC_408
atcgggatcgggcgtacctc

SEQ ID NO: 65156 - DNA, 20 bp, Artificial Sequence
  sgRNA
  NTC_409
gtgtttcgcagtcgacgcga

SEQ ID NO: 65157 - DNA, 20 bp, Artificial Sequence
  sgRNA
  NTC_410
actgggatcgtccgccgtcc

SEQ ID NO: 65158 - DNA, 20 bp, Artificial Sequence
  sgRNA
  NTC_411
tgagcgtacgcgctaaagtt

SEQ ID NO: 65159 - DNA, 20 bp, Artificial Sequence
  sgRNA
  NTC_412
acggttagtcgacgcgccgt

SEQ ID NO: 65160 - DNA, 20 bp, Artificial Sequence
  sgRNA
  NTC_413
ggttcgtggtacactcgcgc

SEQ ID NO: 65161 - DNA, 20 bp, Artificial Sequence
  sgRNA
  NTC_414
acgggcgtttcgagtacgcg

SEQ ID NO: 65162 - DNA, 20 bp, Artificial Sequence
  sgRNA
  NTC_415
gatcacgcgtattacgacag

SEQ ID NO: 65163 - DNA, 20 bp, Artificial Sequence
  sgRNA
  NTC_416
ggagttatcttgacccgacc

SEQ ID NO: 65164 - DNA, 20 bp, Artificial Sequence
  sgRNA
  NTC_417
tatctagaacgcgtaaacga

SEQ ID NO: 65165 - DNA, 20 bp, Artificial Sequence
  sgRNA
  NTC_418
cacgtcgattgcacgaacag

SEQ ID NO: 65166 - DNA, 20 bp, Artificial Sequence
  sgRNA
  NTC_419
caacaacggagctgtcgcat

SEQ ID NO: 65167 - DNA, 20 bp, Artificial Sequence
  sgRNA
  NTC_420
tcaaggtcgaacagcgatac

SEQ ID NO: 65168 - DNA, 20 bp, Artificial Sequence
  sgRNA
  NTC_421
cggacggataacgtcgaccc

SEQ ID NO: 65169 - DNA, 20 bp, Artificial Sequence
  sgRNA
  NTC_422
gaaatcgacgcgcgcctttg

SEQ ID NO: 65170 - DNA, 20 bp, Artificial Sequence
  sgRNA
  NTC_423
tacgtaaggcgcttcgatgt

SEQ ID NO: 65171 - DNA, 20 bp, Artificial Sequence
  sgRNA
  NTC_424
aacaacattgggcgcgcatt

SEQ ID NO: 65172 - DNA, 20 bp, Artificial Sequence
  sgRNA
  NTC_425
cgtcggcactgacgatttat

SEQ ID NO: 65173 - DNA, 20 bp, Artificial Sequence
  sgRNA
  NTC_426
acgaacgacatgtcgtgcga

SEQ ID NO: 65174 - DNA, 20 bp, Artificial Sequence
  sgRNA
  NTC_427
gtcgtggcatcgttcgacta

SEQ ID NO: 65175 - DNA, 20 bp, Artificial Sequence
  sgRNA
  NTC_428
cgtcatctgacgttaccaac

SEQ ID NO: 65176 - DNA, 20 bp, Artificial Sequence
  sgRNA
  NTC_429
tctcagtcgcgactcgcatt

SEQ ID NO: 65177 - DNA, 20 bp, Artificial Sequence
  sgRNA
  NTC_430
atacgcgcaatcgacgtcac

SEQ ID NO: 65178 - DNA, 20 bp, Artificial Sequence
  sgRNA
  NTC_431
cgcacttcgtcacgtctact

SEQ ID NO: 65179 - DNA, 20 bp, Artificial Sequence
  sgRNA
  NTC_432
tgaggatagcagcgcgcttt

SEQ ID NO: 65180 - DNA, 20 bp, Artificial Sequence
  sgRNA
  NTC_433
cgtatcgttgaccgcacgtc

SEQ ID NO: 65181 - DNA, 20 bp, Artificial Sequence
  sgRNA
  NTC_434
ctgaggatcacttcgccgac

SEQ ID NO: 65182 - DNA, 20 bp, Artificial Sequence
  sgRNA
  NTC_435
acgaggttacgcacttagcg

SEQ ID NO: 65183 - DNA, 20 bp, Artificial Sequence
  sgRNA
  NTC_436
cgtacaactgcgccacgacc

SEQ ID NO: 65184 - DNA, 20 bp, Artificial Sequence
  sgRNA
  NTC_437
aagtcgcagtcgccgcgatg

SEQ ID NO: 65185 - DNA, 20 bp, Artificial Sequence
  sgRNA
  NTC_438
gacgcgtgtatgcgctgtat

SEQ ID NO: 65186 - DNA, 20 bp, Artificial Sequence
  sgRNA
  NTC_439
gcatcatacgtatccgctaa

SEQ ID NO: 65187 - DNA, 20 bp, Artificial Sequence
  sgRNA
  NTC_440
ttcacgcaatacccttaccg

SEQ ID NO: 65188 - DNA, 20 bp, Artificial Sequence
  sgRNA
  NTC_441
cgcgcgaacttaatgtaccg

SEQ ID NO: 65189 - DNA, 20 bp, Artificial Sequence
  sgRNA
  NTC_442
atgacgggaatccgtatcat

SEQ ID NO: 65190 - DNA, 20 bp, Artificial Sequence
  sgRNA
  NTC_443
tggtacgttcgtccctcgcg

SEQ ID NO: 65191 - DNA, 20 bp, Artificial Sequence
  sgRNA
  NTC_444
gcattgggctaattcgtatg

SEQ ID NO: 65192 - DNA, 20 bp, Artificial Sequence
  sgRNA
  NTC_445
tcgcggcttcagctatacgc

SEQ ID NO: 65193 - DNA, 20 bp, Artificial Sequence
  sgRNA
  NTC_446
ggatcgtagtggccgtccgt

SEQ ID NO: 65194 - DNA, 20 bp, Artificial Sequence
  sgRNA
  NTC_447
atgaggtagcgttcgtatcc

SEQ ID NO: 65195 - DNA, 20 bp, Artificial Sequence
  sgRNA
  NTC_448
tatgcagtcgcgttatatcg

SEQ ID NO: 65196 - DNA, 20 bp, Artificial Sequence
  sgRNA
  NTC_449
ggttgggcagctgcgataat

SEQ ID NO: 65197 - DNA, 20 bp, Artificial Sequence
  sgRNA
  NTC_450
gagttcacgcgttagtaatc

SEQ ID NO: 65198 - DNA, 20 bp, Artificial Sequence
  sgRNA
  NTC_451
ggtaagcttcactacgcgcc

SEQ ID NO: 65199 - DNA, 20 bp, Artificial Sequence
  sgRNA
  NTC_452
gttacgagcaatcgccaatt

SEQ ID NO: 65200 - DNA, 20 bp, Artificial Sequence
  sgRNA
  NTC_453
acggcgctgatccgcgattc

SEQ ID NO: 65201 - DNA, 20 bp, Artificial Sequence
  sgRNA
  NTC_454
cgcactagtgagttcgtcga

SEQ ID NO: 65202 - DNA, 20 bp, Artificial Sequence
  sgRNA
  NTC_455
acagcgcgtatccacgccgc

SEQ ID NO: 65203 - DNA, 20 bp, Artificial Sequence
  sgRNA
  NTC_456
tgaatgtacgtccacgacgc

SEQ ID NO: 65204 - DNA, 20 bp, Artificial Sequence
  sgRNA
  NTC_457
ggcacgagtcgatgcgtacg

SEQ ID NO: 65205 - DNA, 20 bp, Artificial Sequence
  sgRNA
  NTC_458
gtctgatacgattcgatcgc

SEQ ID NO: 65206 - DNA, 20 bp, Artificial Sequence
  sgRNA
  NTC_459
taatgacgttgagaccgcga

SEQ ID NO: 65207 - DNA, 20 bp, Artificial Sequence
  sgRNA
  NTC_460
caggcgagggtttaccgcgt

SEQ ID NO: 65208 - DNA, 20 bp, Artificial Sequence
  sgRNA
  NTC_461
gcgaaatgtgcgccatgtcc

SEQ ID NO: 65209 - DNA, 20 bp, Artificial Sequence
  sgRNA
  NTC_462
tcgcgcgaacggattatcct

SEQ ID NO: 65210 - DNA, 20 bp, Artificial Sequence
  sgRNA
  NTC_463
acgtcgttgggcgaatcgta

SEQ ID NO: 65211 - DNA, 20 bp, Artificial Sequence
  sgRNA
  NTC_464
ggtgaactaagtcgcgttag

SEQ ID NO: 65212 - DNA, 20 bp, Artificial Sequence
  sgRNA
  NTC_465
atggcgtcgcacccgttagt

SEQ ID NO: 65213 - DNA, 20 bp, Artificial Sequence
  sgRNA
  NTC_466
ggctactaaggacgtccgcg

SEQ ID NO: 65214 - DNA, 20 bp, Artificial Sequence
  sgRNA
  NTC_467
aatagcgaatcgcgtcgcat

SEQ ID NO: 65215 - DNA, 20 bp, Artificial Sequence
  sgRNA
  NTC_468
cattcgtcgcgcgaaacgcg

SEQ ID NO: 65216 - DNA, 20 bp, Artificial Sequence
  sgRNA
  NTC_469
tgcttgggcgcgtccgattt

SEQ ID NO: 65217 - DNA, 20 bp, Artificial Sequence
  sgRNA
  NTC_470
ggcgtaagtgctcccgctag

SEQ ID NO: 65218 - DNA, 20 bp, Artificial Sequence
  sgRNA
  NTC_471
gcgtacaaacgcgccgtgaa

SEQ ID NO: 65219 - DNA, 20 bp, Artificial Sequence
  sgRNA
  NTC_472
ggtgcatcgtcaccccactt

SEQ ID NO: 65220 - DNA, 20 bp, Artificial Sequence
  sgRNA
  NTC_473
aatgcgcgctcacgacccta

SEQ ID NO: 65221 - DNA, 20 bp, Artificial Sequence
  sgRNA
  NTC_474
attatacgtgaactcgcaat

SEQ ID NO: 65222 - DNA, 20 bp, Artificial Sequence
  sgRNA
  NTC_475
gcaaattgcgaccgtgcgat

SEQ ID NO: 65223 - DNA, 20 bp, Artificial Sequence
  sgRNA
  NTC_476
cggattcagattgacgcgcg

SEQ ID NO: 65224 - DNA, 20 bp, Artificial Sequence
  sgRNA
  NTC_477
ataattcgggctacgccgta

SEQ ID NO: 65225 - DNA, 20 bp, Artificial Sequence
  sgRNA
  NTC_478
ggtcggtcgtcagtcgtgta

SEQ ID NO: 65226 - DNA, 20 bp, Artificial Sequence
  sgRNA
  NTC_479
atttcacagcgcacgcgatg

SEQ ID NO: 65227 - DNA, 20 bp, Artificial Sequence
  sgRNA
  NTC_480
ttctcacacgcgcacgtcgc

SEQ ID NO: 65228 - DNA, 20 bp, Artificial Sequence
  sgRNA
  NTC_481
acgagcgcatagtccgtcag

SEQ ID NO: 65229 - DNA, 20 bp, Artificial Sequence
  sgRNA
  NTC_482
acgtcgagcgtcccgtgagc

SEQ ID NO: 65230 - DNA, 20 bp, Artificial Sequence
  sgRNA
  NTC_483
cgttacgtgtcacgcgatca

SEQ ID NO: 65231 - DNA, 20 bp, Artificial Sequence
  sgRNA
  NTC_484
gctctactaagcgccgaagt

SEQ ID NO: 65232 - DNA, 20 bp, Artificial Sequence
  sgRNA
  NTC_485
acgtctgatctcgacgacct

SEQ ID NO: 65233 - DNA, 20 bp, Artificial Sequence
  sgRNA
  NTC_486
ggctgtatgcttaccgctta

SEQ ID NO: 65234 - DNA, 20 bp, Artificial Sequence
  sgRNA
  NTC_487
gatggaactcatcgcgcttc

SEQ ID NO: 65235 - DNA, 20 bp, Artificial Sequence
  sgRNA
  NTC_488
cggtaatcgtcttgcgtacg

SEQ ID NO: 65236 - DNA, 20 bp, Artificial Sequence
  sgRNA
  NTC_489
aagtttgtgacgctaccgat

SEQ ID NO: 65237 - DNA, 20 bp, Artificial Sequence
  sgRNA
  NTC_490
gcgctatctcgcgtagcgaa

SEQ ID NO: 65238 - DNA, 20 bp, Artificial Sequence
  sgRNA
  NTC_491
tcactatcacgcaacgaacg

SEQ ID NO: 65239 - DNA, 20 bp, Artificial Sequence
  sgRNA
  NTC_492
cgatcaaagttcgcccgtcg

SEQ ID NO: 65240 - DNA, 20 bp, Artificial Sequence
  sgRNA
  NTC_493
gacggctttatcgagcgact

SEQ ID NO: 65241 - DNA, 20 bp, Artificial Sequence
  sgRNA
  NTC_494
ttcgcgacgtcacgtctcgc

SEQ ID NO: 65242 - DNA, 20 bp, Artificial Sequence
  sgRNA
  NTC_495
tgcgacgtaggttcgactct

SEQ ID NO: 65243 - DNA, 20 bp, Artificial Sequence
  sgRNA
  NTC_496
acgtacgaacataccgttgc

SEQ ID NO: 65244 - DNA, 20 bp, Artificial Sequence
  sgRNA
  NTC_497
ggtgtactgagtaacgcgcg

SEQ ID NO: 65245 - DNA, 20 bp, Artificial Sequence
  sgRNA
  NTC_498
gctcgacatcacgttgcgcg

SEQ ID NO: 65246 - DNA, 20 bp, Artificial Sequence
  sgRNA
  NTC_499
aatcgctcgaacttgcgttc

SEQ ID NO: 65247 - DNA, 20 bp, Artificial Sequence
  sgRNA
  NTC_500
acgatctgacgctaccgacg

SEQ ID NO: 65248 - DNA, 20 bp, Artificial Sequence
  sgRNA
  NTC_501
ggcgtatcggtaccaactaa

SEQ ID NO: 65249 - DNA, 20 bp, Artificial Sequence
  sgRNA
  NTC_502
ggattcgactcgcgacataa

SEQ ID NO: 65250 - DNA, 20 bp, Artificial Sequence
  sgRNA
  NTC_503
ctatacgtctcgtcatcgac

SEQ ID NO: 65251 - DNA, 20 bp, Artificial Sequence
  sgRNA
  NTC_504
gtaggcgaatcgcgtgctcg

SEQ ID NO: 65252 - DNA, 20 bp, Artificial Sequence
  sgRNA
  NTC_505
aggcgaacgtcgctactcat

SEQ ID NO: 65253 - DNA, 20 bp, Artificial Sequence
  sgRNA
  NTC_506
ggtatacttgatcgatcgtt

SEQ ID NO: 65254 - DNA, 20 bp, Artificial Sequence
  sgRNA
  NTC_507
cgtatgggttcacgtaccgc

SEQ ID NO: 65255 - DNA, 20 bp, Artificial Sequence
  sgRNA
  NTC_508
tagcattatcgccgttcccg

SEQ ID NO: 65256 - DNA, 20 bp, Artificial Sequence
  sgRNA
  NTC_509
tcgaaggcgatccgccgact

SEQ ID NO: 65257 - DNA, 20 bp, Artificial Sequence
  sgRNA
  NTC_510
gcttcgcgacgataactctg

SEQ ID NO: 65258 - DNA, 20 bp, Artificial Sequence
  sgRNA
  NTC_511
gacggtcgtacgccgcatcg

SEQ ID NO: 65259 - DNA, 20 bp, Artificial Sequence
  sgRNA
  NTC_512
ctaatgaatacgcgagacgc

SEQ ID NO: 65260 - DNA, 20 bp, Artificial Sequence
  sgRNA
  NTC_513
cgacgtggattatgtcgccg

SEQ ID NO: 65261 - DNA, 20 bp, Artificial Sequence
  sgRNA
  NTC_514
gcgcatcagcgtcgtagcgc

SEQ ID NO: 65262 - DNA, 20 bp, Artificial Sequence
  sgRNA
  NTC_515
attcgaatgatttacgcgca

SEQ ID NO: 65263 - DNA, 20 bp, Artificial Sequence
  sgRNA
  NTC_516
gcattacggtcgtgatcagc

SEQ ID NO: 65264 - DNA, 20 bp, Artificial Sequence
  sgRNA
  NTC_517
cgcgctattgagctatactc

SEQ ID NO: 65265 - DNA, 20 bp, Artificial Sequence
  sgRNA
  NTC_518
acggtgttgcgttgcgcgca

SEQ ID NO: 65266 - DNA, 20 bp, Artificial Sequence
  sgRNA
  NTC_519
acgcaatgagtgataatcga

SEQ ID NO: 65267 - DNA, 20 bp, Artificial Sequence
  sgRNA
  NTC_520
tactacacgtgattgcgccg

SEQ ID NO: 65268 - DNA, 20 bp, Artificial Sequence
  sgRNA
  NTC_521
cgatcgtacgttattcgtca

SEQ ID NO: 65269 - DNA, 20 bp, Artificial Sequence
  sgRNA
  NTC_522
taacgtacggctacgacagt

SEQ ID NO: 65270 - DNA, 20 bp, Artificial Sequence
  sgRNA
  NTC_523
ggggtattgttgcgctcaac

SEQ ID NO: 65271 - DNA, 20 bp, Artificial Sequence
  sgRNA
  NTC_524
agattgggtgtcgtcccgct

SEQ ID NO: 65272 - DNA, 20 bp, Artificial Sequence
  sgRNA
  NTC_525
tagcaacgacgcgatatctc

SEQ ID NO: 65273 - DNA, 20 bp, Artificial Sequence
  sgRNA
  NTC_526
acgctcgcaaatcgtaaagc

SEQ ID NO: 65274 - DNA, 20 bp, Artificial Sequence
  sgRNA
  NTC_527
tgacttcatgcgcccaagcg

SEQ ID NO: 65275 - DNA, 20 bp, Artificial Sequence
  sgRNA
  NTC_528
gatacggcgtaatacgagat

SEQ ID NO: 65276 - DNA, 20 bp, Artificial Sequence
  sgRNA
  NTC_529
tgctcacgacgacgtactta

SEQ ID NO: 65277 - DNA, 20 bp, Artificial Sequence
  sgRNA
  NTC_530
gcgaaaatggcatacgacta

SEQ ID NO: 65278 - DNA, 20 bp, Artificial Sequence
  sgRNA
  NTC_531
gcgacgcgattaccgaccaa

SEQ ID NO: 65279 - DNA, 20 bp, Artificial Sequence
  sgRNA
  NTC_532
cacagacttcgcgagcgttt

SEQ ID NO: 65280 - DNA, 20 bp, Artificial Sequence
  sgRNA
  NTC_533
taggttctcgtgttacttcg

SEQ ID NO: 65281 - DNA, 20 bp, Artificial Sequence
  sgRNA
  NTC_534
tattgttcgatcgaacgcga

SEQ ID NO: 65282 - DNA, 20 bp, Artificial Sequence
  sgRNA
  NTC_535
gatagcgatgataccgatcg

SEQ ID NO: 65283 - DNA, 20 bp, Artificial Sequence
  sgRNA
  NTC_536
cgcaacgggcatatagtacg

SEQ ID NO: 65284 - DNA, 20 bp, Artificial Sequence
  sgRNA
  NTC_537
ctatcggtttcgtcgcgtcc

SEQ ID NO: 65285 - DNA, 20 bp, Artificial Sequence
  sgRNA
  NTC_538
ttgggtgcgcacctccgata

SEQ ID NO: 65286 - DNA, 20 bp, Artificial Sequence
  sgRNA
  NTC_539
cggcaggacgttcgtactcg

SEQ ID NO: 65287 - DNA, 20 bp, Artificial Sequence
  sgRNA
  NTC_540
atacgggtggactcgcgacc

SEQ ID NO: 65288 - DNA, 20 bp, Artificial Sequence
  sgRNA
  NTC_541
tagtcgacgataacattgcg

SEQ ID NO: 65289 - DNA, 20 bp, Artificial Sequence
  sgRNA
  NTC_542
caaacgcgagcgaatcgcgc

SEQ ID NO: 65290 - DNA, 20 bp, Artificial Sequence
  sgRNA
  NTC_543
gaattgcactcgtacgctac

SEQ ID NO: 65291 - DNA, 20 bp, Artificial Sequence
  sgRNA
  NTC_544
gcggacaggcgtctaataac

SEQ ID NO: 65292 - DNA, 20 bp, Artificial Sequence
  sgRNA
  NTC_545
cacagcacgttaatcgcatc

SEQ ID NO: 65293 - DNA, 20 bp, Artificial Sequence
  sgRNA
  NTC_546
ggttgggtaagactcgtatc

SEQ ID NO: 65294 - DNA, 20 bp, Artificial Sequence
  sgRNA
  NTC_547
cggaacgtgcaccgttgcat

SEQ ID NO: 65295 - DNA, 20 bp, Artificial Sequence
  sgRNA
  NTC_548
ctcggttcgtaacgccatga

SEQ ID NO: 65296 - DNA, 20 bp, Artificial Sequence
  sgRNA
  NTC_549
gtatacacggttcgtatctt

SEQ ID NO: 65297 - DNA, 20 bp, Artificial Sequence
  sgRNA
  NTC_550
cggtcaacgggagttcgttt

SEQ ID NO: 65298 - DNA, 20 bp, Artificial Sequence
  sgRNA
  NTC_551
gtatcgaggcggttcgaaaa

SEQ ID NO: 65299 - DNA, 20 bp, Artificial Sequence
  sgRNA
  NTC_552
cggaaggtgacgcgctatca

SEQ ID NO: 65300 - DNA, 20 bp, Artificial Sequence
  sgRNA
  NTC_553
tcaacgcatctcacgcgcat

SEQ ID NO: 65301 - DNA, 20 bp, Artificial Sequence
  sgRNA
  NTC_554
ttaagtgcgcacgcgattcg

SEQ ID NO: 65302 - DNA, 20 bp, Artificial Sequence
  sgRNA
  NTC_555
ctgatttacgagtacgccgt

SEQ ID NO: 65303 - DNA, 20 bp, Artificial Sequence
  sgRNA
  NTC_556
cgcggttgaatgttcgttaa

SEQ ID NO: 65304 - DNA, 20 bp, Artificial Sequence
  sgRNA
  NTC_557
actctgggcgcaagcgtctg

SEQ ID NO: 65305 - DNA, 20 bp, Artificial Sequence
  sgRNA
  NTC_558
gcgacggcttagtaccctac

SEQ ID NO: 65306 - DNA, 20 bp, Artificial Sequence
  sgRNA
  NTC_559
cttgcggcaaacgtgcctag

SEQ ID NO: 65307 - DNA, 20 bp, Artificial Sequence
  sgRNA
  NTC_560
aatacggctcgtgtttgacg

SEQ ID NO: 65308 - DNA, 20 bp, Artificial Sequence
  sgRNA
  NTC_561
ctcgcgaacgacccgtaaag

SEQ ID NO: 65309 - DNA, 20 bp, Artificial Sequence
  sgRNA
  NTC_562
atacgtatttcgtgcgccct

SEQ ID NO: 65310 - DNA, 20 bp, Artificial Sequence
  sgRNA
  NTC_563
cgtctgggcggcattcaatc

SEQ ID NO: 65311 - DNA, 20 bp, Artificial Sequence
  sgRNA
  NTC_564
agcgaagggacgacctgcac

SEQ ID NO: 65312 - DNA, 20 bp, Artificial Sequence
  sgRNA
  NTC_565
gctctcacgcgcttcgtgtc

SEQ ID NO: 65313 - DNA, 20 bp, Artificial Sequence
  sgRNA
  NTC_566
gtgcgatcttaccgcacgac

SEQ ID NO: 65314 - DNA, 20 bp, Artificial Sequence
  sgRNA
  NTC_567
cggcgagagcactcgataag

SEQ ID NO: 65315 - DNA, 20 bp, Artificial Sequence
  sgRNA
  NTC_568
atcgtttgtactgacgctta

SEQ ID NO: 65316 - DNA, 20 bp, Artificial Sequence
  sgRNA
  NTC_569
agctacaagcgttagtgcgc

SEQ ID NO: 65317 - DNA, 20 bp, Artificial Sequence
  sgRNA
  NTC_570
ggcggctcgaattgtcgatc

SEQ ID NO: 65318 - DNA, 20 bp, Artificial Sequence
  sgRNA
  NTC_571
acgcggcgtcagcccctatc

SEQ ID NO: 65319 - DNA, 20 bp, Artificial Sequence
  sgRNA
  NTC_572
acgtgacgatcacgtaacga

SEQ ID NO: 65320 - DNA, 20 bp, Artificial Sequence
  sgRNA
  NTC_573
gcgctaagtcaatgcgctcg

SEQ ID NO: 65321 - DNA, 20 bp, Artificial Sequence
  sgRNA
  NTC_574
tgcgatttgtcgcgagctat

SEQ ID NO: 65322 - DNA, 20 bp, Artificial Sequence
  sgRNA
  NTC_575
gggaggctagacgatcgacg

SEQ ID NO: 65323 - DNA, 20 bp, Artificial Sequence
  sgRNA
  NTC_576
gagagtatcgatcgccgcac

SEQ ID NO: 65324 - DNA, 20 bp, Artificial Sequence
  sgRNA
  NTC_577
gttcgagaagtattgcgcgt

SEQ ID NO: 65325 - DNA, 20 bp, Artificial Sequence
  sgRNA
  NTC_578
ggattcgcgatttcgactac

SEQ ID NO: 65326 - DNA, 20 bp, Artificial Sequence
  sgRNA
  NTC_579
acaggtttgctatcgtatta

SEQ ID NO: 65327 - DNA, 20 bp, Artificial Sequence
  sgRNA
  NTC_580
agttaagctcaaccgtcgcg

SEQ ID NO: 65328 - DNA, 20 bp, Artificial Sequence
  sgRNA
  NTC_581
gcgctagacgacactcgtag

SEQ ID NO: 65329 - DNA, 20 bp, Artificial Sequence
  sgRNA
  NTC_582
cgcagcgtaatacgcgtatc

SEQ ID NO: 65330 - DNA, 20 bp, Artificial Sequence
  sgRNA
  NTC_583
ctcggcaaaaagtgcgtcaa

SEQ ID NO: 65331 - DNA, 20 bp, Artificial Sequence
  sgRNA
  NTC_584
tacacgtcgttgtagagccg

SEQ ID NO: 65332 - DNA, 20 bp, Artificial Sequence
  sgRNA
  NTC_585
ttacgacgatcgatgactcg

SEQ ID NO: 65333 - DNA, 20 bp, Artificial Sequence
  sgRNA
  NTC_586
gtcgacgtactaaagcgaca

SEQ ID NO: 65334 - DNA, 20 bp, Artificial Sequence
  sgRNA
  NTC_587
cgaaaagagacgcgacccta

SEQ ID NO: 65335 - DNA, 20 bp, Artificial Sequence
  sgRNA
  NTC_588
gtaagttcgctataacctgc

SEQ ID NO: 65336 - DNA, 20 bp, Artificial Sequence
  sgRNA
  NTC_589
aaattgcactacgcgacccc

SEQ ID NO: 65337 - DNA, 20 bp, Artificial Sequence
  sgRNA
  NTC_590
gcgcgtaggaggtgcgattg

SEQ ID NO: 65338 - DNA, 20 bp, Artificial Sequence
  sgRNA
  NTC_591
cgcgcagggggcgtgtatcc

SEQ ID NO: 65339 - DNA, 20 bp, Artificial Sequence
  sgRNA
  NTC_592
acgcgcggtgtccacaatcg

SEQ ID NO: 65340 - DNA, 20 bp, Artificial Sequence
  sgRNA
  NTC_593
tcgtaatcgtggtcaacgtc

SEQ ID NO: 65341 - DNA, 20 bp, Artificial Sequence
  sgRNA
  NTC_594
acggtgaacttgcacgattt

SEQ ID NO: 65342 - DNA, 20 bp, Artificial Sequence
  sgRNA
  NTC_595
cgactctgatatagcgacgt

SEQ ID NO: 65343 - DNA, 20 bp, Artificial Sequence
  sgRNA
  NTC_596
ggctaatcactcagcgcgcg

SEQ ID NO: 65344 - DNA, 20 bp, Artificial Sequence
  sgRNA
  NTC_597
gctgaacgttcactatcgaa

SEQ ID NO: 65345 - DNA, 20 bp, Artificial Sequence
  sgRNA
  NTC_598
gcggaggcggtctcaaatcg

SEQ ID NO: 65346 - DNA, 20 bp, Artificial Sequence
  sgRNA
  NTC_599
acacgagcttcgtaccgaat

SEQ ID NO: 65347 - DNA, 20 bp, Artificial Sequence
  sgRNA
  NTC_600
agtagacaatggctcgcgta

SEQ ID NO: 65348 - DNA, 20 bp, Artificial Sequence
  sgRNA
  NTC_601
ttatgttaaatacgcctcgc

SEQ ID NO: 65349 - DNA, 20 bp, Artificial Sequence
  sgRNA
  NTC_602
ttactaatcttgtacgaccg

SEQ ID NO: 65350 - DNA, 20 bp, Artificial Sequence
  sgRNA
  NTC_603
gatacaaaagcgcgcgtcga

SEQ ID NO: 65351 - DNA, 20 bp, Artificial Sequence
  sgRNA
  NTC_604
agcgtgttgacgtttcgttg

SEQ ID NO: 65352 - DNA, 20 bp, Artificial Sequence
  sgRNA
  NTC_605
acacggcgagtccgtcgccc

SEQ ID NO: 65353 - DNA, 20 bp, Artificial Sequence
  sgRNA
  NTC_606
tctctagcagatcgcgtcgt

SEQ ID NO: 65354 - DNA, 20 bp, Artificial Sequence
  sgRNA
  NTC_607
tatcgcaatgtttgcgagat

SEQ ID NO: 65355 - DNA, 20 bp, Artificial Sequence
  sgRNA
  NTC_608
acgtaagatgagcgacgttc

SEQ ID NO: 65356 - DNA, 20 bp, Artificial Sequence
  sgRNA
  NTC_609
catcgaggggtccgcttgat

SEQ ID NO: 65357 - DNA, 20 bp, Artificial Sequence
  sgRNA
  NTC_610
gcgtcggcttgtacgaccgc

SEQ ID NO: 65358 - DNA, 20 bp, Artificial Sequence
  sgRNA
  NTC_611
cacgaaactgcgctcgagta

SEQ ID NO: 65359 - DNA, 20 bp, Artificial Sequence
  sgRNA
  NTC_612
ggacgttgggactcgtaagt

SEQ ID NO: 65360 - DNA, 20 bp, Artificial Sequence
  sgRNA
  NTC_613
tacatttgtctcgccgtccg

SEQ ID NO: 65361 - DNA, 20 bp, Artificial Sequence
  sgRNA
  NTC_614
ctgtactgtgaccgtaacgt

SEQ ID NO: 65362 - DNA, 20 bp, Artificial Sequence
  sgRNA
  NTC_615
gtaattatggacgcgccacc

SEQ ID NO: 65363 - DNA, 20 bp, Artificial Sequence
  sgRNA
  NTC_616
ttggattcgagcgcgcgcat

SEQ ID NO: 65364 - DNA, 20 bp, Artificial Sequence
  sgRNA
  NTC_617
tcaatatacgcgcgcgcgct

SEQ ID NO: 65365 - DNA, 20 bp, Artificial Sequence
  sgRNA
  NTC_618
gtcgcgtctagcgtgaataa

SEQ ID NO: 65366 - DNA, 20 bp, Artificial Sequence
  sgRNA
  NTC_619
tcgcgcacgagctgattaag

SEQ ID NO: 65367 - DNA, 20 bp, Artificial Sequence
  sgRNA
  NTC_620
aactagtgacgcgtcccgcc

SEQ ID NO: 65368 - DNA, 20 bp, Artificial Sequence
  sgRNA
  NTC_621
gttagacgcaacgcgaccgc

SEQ ID NO: 65369 - DNA, 20 bp, Artificial Sequence
  sgRNA
  NTC_622
gatgcggctactcatgccgc

SEQ ID NO: 65370 - DNA, 20 bp, Artificial Sequence
  sgRNA
  NTC_623
atcacgtatggatccgctat

SEQ ID NO: 65371 - DNA, 20 bp, Artificial Sequence
  sgRNA
  NTC_624
atcgcgacgctcctcgactc

SEQ ID NO: 65372 - DNA, 20 bp, Artificial Sequence
  sgRNA
  NTC_625
atatagcgctctaccgcaat

SEQ ID NO: 65373 - DNA, 20 bp, Artificial Sequence
  sgRNA
  NTC_626
cgaactaacgtagaccgcga

SEQ ID NO: 65374 - DNA, 20 bp, Artificial Sequence
  sgRNA
  NTC_627
aacgtagactgctcgccgaa

SEQ ID NO: 65375 - DNA, 20 bp, Artificial Sequence
  sgRNA
  NTC_628
gcgatcaggtcgcgttatct

SEQ ID NO: 65376 - DNA, 20 bp, Artificial Sequence
  sgRNA
  NTC_629
cgatcgtgtacgatcccctg

SEQ ID NO: 65377 - DNA, 20 bp, Artificial Sequence
  sgRNA
  NTC_630
gtagtatataggcgcgcctc

SEQ ID NO: 65378 - DNA, 20 bp, Artificial Sequence
  sgRNA
  NTC_631
ctaaaggcggatccacgtcc

SEQ ID NO: 65379 - DNA, 20 bp, Artificial Sequence
  sgRNA
  NTC_632
agtatggagcgcgctattcg

SEQ ID NO: 65380 - DNA, 20 bp, Artificial Sequence
  sgRNA
  NTC_633
ctctatacgactcccgcgac

SEQ ID NO: 65381 - DNA, 20 bp, Artificial Sequence
  sgRNA
  NTC_634
gtctcgcgttagagtcgcat

SEQ ID NO: 65382 - DNA, 20 bp, Artificial Sequence
  sgRNA
  NTC_635
atcaactcggacgcccgacg

SEQ ID NO: 65383 - DNA, 20 bp, Artificial Sequence
  sgRNA
  NTC_636
gacacaagcgcgtgaaccgc

SEQ ID NO: 65384 - DNA, 20 bp, Artificial Sequence
  sgRNA
  NTC_637
cgaatacgggtacgatcgtg

SEQ ID NO: 65385 - DNA, 20 bp, Artificial Sequence
  sgRNA
  NTC_638
aatatactgtcgttcgatcg

SEQ ID NO: 65386 - DNA, 20 bp, Artificial Sequence
  sgRNA
  NTC_639
tcgtggacggtgtaaacgat

SEQ ID NO: 65387 - DNA, 20 bp, Artificial Sequence
  sgRNA
  NTC_640
tagcgcgctcgtcgctatat

SEQ ID NO: 65388 - DNA, 20 bp, Artificial Sequence
  sgRNA
  NTC_641
catgtcggcgcacgaaatcg

SEQ ID NO: 65389 - DNA, 20 bp, Artificial Sequence
  sgRNA
  NTC_642
cgtcttcgacttgtcacgcg

SEQ ID NO: 65390 - DNA, 20 bp, Artificial Sequence
  sgRNA
  NTC_643
tcattcggtcgcgcgtaatt

SEQ ID NO: 65391 - DNA, 20 bp, Artificial Sequence
  sgRNA
  NTC_644
atttactagtgcgacaccac

SEQ ID NO: 65392 - DNA, 20 bp, Artificial Sequence
  sgRNA
  NTC_645
cgttatcaaagcaccgcgcc

SEQ ID NO: 65393 - DNA, 20 bp, Artificial Sequence
  sgRNA
  NTC_646
ttgggataagacgcgagaca

SEQ ID NO: 65394 - DNA, 20 bp, Artificial Sequence
  sgRNA
  NTC_647
agtcatgtctagtcgcgcat

SEQ ID NO: 65395 - DNA, 20 bp, Artificial Sequence
  sgRNA
  NTC_648
tttcgtggacttcgcccgag

SEQ ID NO: 65396 - DNA, 20 bp, Artificial Sequence
  sgRNA
  NTC_649
tcacggggtgcgccacaact

SEQ ID NO: 65397 - DNA, 20 bp, Artificial Sequence
  sgRNA
  NTC_650
cttctagcggatgtcgactg

SEQ ID NO: 65398 - DNA, 20 bp, Artificial Sequence
  sgRNA
  NTC_651
tcggcacggaaagccgaacg

SEQ ID NO: 65399 - DNA, 20 bp, Artificial Sequence
  sgRNA
  NTC_652
acgactcgacgcatagagcg

SEQ ID NO: 65400 - DNA, 20 bp, Artificial Sequence
  sgRNA
  NTC_653
tacgagcatttgcgttgtcg

SEQ ID NO: 65401 - DNA, 20 bp, Artificial Sequence
  sgRNA
  NTC_654
attatcggggttctcgtcat

SEQ ID NO: 65402 - DNA, 20 bp, Artificial Sequence
  sgRNA
  NTC_655
cggtcgtctactagccgtaa

SEQ ID NO: 65403 - DNA, 20 bp, Artificial Sequence
  sgRNA
  NTC_656
ttaacgtcggatagtacctt

SEQ ID NO: 65404 - DNA, 20 bp, Artificial Sequence
  sgRNA
  NTC_657
ttggttatacggctcgcaac

SEQ ID NO: 65405 - DNA, 20 bp, Artificial Sequence
  sgRNA
  NTC_658
gcgcgaagaacgatccacat

SEQ ID NO: 65406 - DNA, 20 bp, Artificial Sequence
  sgRNA
  NTC_659
gcggtaaaaaggttcgcaat

SEQ ID NO: 65407 - DNA, 20 bp, Artificial Sequence
  sgRNA
  NTC_660
acgttggactattccgccac

SEQ ID NO: 65408 - DNA, 20 bp, Artificial Sequence
  sgRNA
  NTC_661
taagcgcgcgacgtcacatt

SEQ ID NO: 65409 - DNA, 20 bp, Artificial Sequence
  sgRNA
  NTC_662
cgtcgaagtctcccgcgcca

SEQ ID NO: 65410 - DNA, 20 bp, Artificial Sequence
  sgRNA
  NTC_663
gttcgcttatgcaatagacg

SEQ ID NO: 65411 - DNA, 20 bp, Artificial Sequence
  sgRNA
  NTC_664
ttcgcaacggacgtccgctt

SEQ ID NO: 65412 - DNA, 20 bp, Artificial Sequence
  sgRNA
  NTC_665
tggtgcttaatgcgagcgcg

SEQ ID NO: 65413 - DNA, 20 bp, Artificial Sequence
  sgRNA
  NTC_666
tcgcgtaatatcctcgatgc

SEQ ID NO: 65414 - DNA, 20 bp, Artificial Sequence
  sgRNA
  NTC_667
tagcgttacgggcgacccgt

SEQ ID NO: 65415 - DNA, 20 bp, Artificial Sequence
  sgRNA
  NTC_668
gttaatgcgtgaacgccgag

SEQ ID NO: 65416 - DNA, 20 bp, Artificial Sequence
  sgRNA
  NTC_669
gtatagcggtgctccgaccg

SEQ ID NO: 65417 - DNA, 20 bp, Artificial Sequence
  sgRNA
  NTC_670
gtacactacgtacgttgatt

SEQ ID NO: 65418 - DNA, 20 bp, Artificial Sequence
  sgRNA
  NTC_671
ggcagatacggtcgcccgta

SEQ ID NO: 65419 - DNA, 20 bp, Artificial Sequence
  sgRNA
  NTC_672
ggtcgggaaacattccgcgc

SEQ ID NO: 65420 - DNA, 20 bp, Artificial Sequence
  sgRNA
  NTC_673
aattacattagcgcgcgacg

SEQ ID NO: 65421 - DNA, 20 bp, Artificial Sequence
  sgRNA
  NTC_674
cgtagtagttgtcgcgtcat

SEQ ID NO: 65422 - DNA, 20 bp, Artificial Sequence
  sgRNA
  NTC_675
ggctcgcttagaacgtctat

SEQ ID NO: 65423 - DNA, 20 bp, Artificial Sequence
  sgRNA
  NTC_676
gtcatcgaggagcgtcatac

SEQ ID NO: 65424 - DNA, 20 bp, Artificial Sequence
  sgRNA
  NTC_677
gaataggcgaatcgcgcagt

SEQ ID NO: 65425 - DNA, 20 bp, Artificial Sequence
  sgRNA
  NTC_678
ggtggcgcgtatgccgtaag

SEQ ID NO: 65426 - DNA, 20 bp, Artificial Sequence
  sgRNA
  NTC_679
acatggtactaacccgttcg

SEQ ID NO: 65427 - DNA, 20 bp, Artificial Sequence
  sgRNA
  NTC_680
tgtattacgggcgcgtacag

SEQ ID NO: 65428 - DNA, 20 bp, Artificial Sequence
  sgRNA
  NTC_681
ttaaatacgctccgcgatct

SEQ ID NO: 65429 - DNA, 20 bp, Artificial Sequence
  sgRNA
  NTC_682
tagctgcgagtcgatcatcg

SEQ ID NO: 65430 - DNA, 20 bp, Artificial Sequence
  sgRNA
  NTC_683
acggactagacttacgatcg

SEQ ID NO: 65431 - DNA, 20 bp, Artificial Sequence
  sgRNA
  NTC_684
tcatagcgcgttcgcgatca

SEQ ID NO: 65432 - DNA, 20 bp, Artificial Sequence
  sgRNA
  NTC_685
gtcggtatatacctcgacga

SEQ ID NO: 65433 - DNA, 20 bp, Artificial Sequence
  sgRNA
  NTC_686
cacacgctgattgcgaccgc

SEQ ID NO: 65434 - DNA, 20 bp, Artificial Sequence
  sgRNA
  NTC_687
atctacatagcacgacgcct

SEQ ID NO: 65435 - DNA, 20 bp, Artificial Sequence
  sgRNA
  NTC_688
tacggtcgtcacgcgcctag

SEQ ID NO: 65436 - DNA, 20 bp, Artificial Sequence
  sgRNA
  NTC_689
agcgcactattgccgtaacg

SEQ ID NO: 65437 - DNA, 20 bp, Artificial Sequence
  sgRNA
  NTC_690
gggtcgcggtactcatcgca

SEQ ID NO: 65438 - DNA, 20 bp, Artificial Sequence
  sgRNA
  NTC_691
aagtagcgacgtaccgttac

SEQ ID NO: 65439 - DNA, 20 bp, Artificial Sequence
  sgRNA
  NTC_692
tctagtaaaatcagcgcgtc

SEQ ID NO: 65440 - DNA, 20 bp, Artificial Sequence
  sgRNA
  NTC_693
cgtcggcgcaacgaaccgat

SEQ ID NO: 65441 - DNA, 20 bp, Artificial Sequence
  sgRNA
  NTC_694
ggctagaacacgctacgaca

SEQ ID NO: 65442 - DNA, 20 bp, Artificial Sequence
  sgRNA
  NTC_695
gcggcgcgctcaaagtatag

SEQ ID NO: 65443 - DNA, 20 bp, Artificial Sequence
  sgRNA
  NTC_696
gcgtgatacgtgccacgcct

SEQ ID NO: 65444 - DNA, 20 bp, Artificial Sequence
  sgRNA
  NTC_697
gatcgctggcttctcgcaat

SEQ ID NO: 65445 - DNA, 20 bp, Artificial Sequence
  sgRNA
  NTC_698
ctatgcggttcgataaccag

SEQ ID NO: 65446 - DNA, 20 bp, Artificial Sequence
  sgRNA
  NTC_699
gcacaatcggctcgagagac

SEQ ID NO: 65447 - DNA, 20 bp, Artificial Sequence
  sgRNA
  NTC_700
atacgtacacgctcgtcgaa

SEQ ID NO: 65448 - DNA, 20 bp, Artificial Sequence
  sgRNA
  NTC_701
cagcacgaactcgtatcgtt

SEQ ID NO: 65449 - DNA, 20 bp, Artificial Sequence
  sgRNA
  NTC_702
tgtaggcgagatcgctcgag

SEQ ID NO: 65450 - DNA, 20 bp, Artificial Sequence
  sgRNA
  NTC_703
atagcgcgaatcctatgcgt

SEQ ID NO: 65451 - DNA, 20 bp, Artificial Sequence
  sgRNA
  NTC_704
tcttcggagtactccgcttg

SEQ ID NO: 65452 - DNA, 20 bp, Artificial Sequence
  sgRNA
  NTC_705
atgcacgtctttccgtccgt

SEQ ID NO: 65453 - DNA, 20 bp, Artificial Sequence
  sgRNA
  NTC_706
ggacgaatcgctatagtccg

SEQ ID NO: 65454 - DNA, 20 bp, Artificial Sequence
  sgRNA
  NTC_707
agcggacggaacgcgcgatt

SEQ ID NO: 65455 - DNA, 20 bp, Artificial Sequence
  sgRNA
  NTC_708
gacgtgcgattcgccgctga

SEQ ID NO: 65456 - DNA, 20 bp, Artificial Sequence
  sgRNA
  NTC_709
ctgacgtggataaccctcgt

SEQ ID NO: 65457 - DNA, 20 bp, Artificial Sequence
  sgRNA
  NTC_710
ttgcgcgtcaatccgtcgaa

SEQ ID NO: 65458 - DNA, 20 bp, Artificial Sequence
  sgRNA
  NTC_711
ggcggcgagcgccttcgttg

SEQ ID NO: 65459 - DNA, 20 bp, Artificial Sequence
  sgRNA
  NTC_712
aagatcgtctatcccgacgc

SEQ ID NO: 65460 - DNA, 20 bp, Artificial Sequence
  sgRNA
  NTC_713
gttcacgtggtcgcacgtag

SEQ ID NO: 65461 - DNA, 20 bp, Artificial Sequence
  sgRNA
  NTC_714
gtataggatctcgcttgacg

SEQ ID NO: 65462 - DNA, 20 bp, Artificial Sequence
  sgRNA
  NTC_715
cgttgcacgggcgacccgct

SEQ ID NO: 65463 - DNA, 20 bp, Artificial Sequence
  sgRNA
  NTC_716
atagcgacgtgcgctaaaag

SEQ ID NO: 65464 - DNA, 20 bp, Artificial Sequence
  sgRNA
  NTC_717
gcgggtcgatcagacgaaca

SEQ ID NO: 65465 - DNA, 20 bp, Artificial Sequence
  sgRNA
  NTC_718
aattctagcgtaatgcgtcg

SEQ ID NO: 65466 - DNA, 20 bp, Artificial Sequence
  sgRNA
  NTC_719
gttacgtcgacgagtatatt

SEQ ID NO: 65467 - DNA, 20 bp, Artificial Sequence
  sgRNA
  NTC_720
tcgattgttagcgacgcgta

SEQ ID NO: 65468 - DNA, 20 bp, Artificial Sequence
  sgRNA
  NTC_721
tcgaacggtgcaccgaattt

SEQ ID NO: 65469 - DNA, 20 bp, Artificial Sequence
  sgRNA
  NTC_722
gaacgaacgggaatcgccca

SEQ ID NO: 65470 - DNA, 20 bp, Artificial Sequence
  sgRNA
  NTC_723
gtaagttaactgccgcgtta

SEQ ID NO: 65471 - DNA, 20 bp, Artificial Sequence
  sgRNA
  NTC_724
ttcgctcgtagagttgcgta

SEQ ID NO: 65472 - DNA, 20 bp, Artificial Sequence
  sgRNA
  NTC_725
gtgtggtgacgtaccgaatt

SEQ ID NO: 65473 - DNA, 20 bp, Artificial Sequence
  sgRNA
  NTC_726
ctcggtagtcataccgcacg

SEQ ID NO: 65474 - DNA, 20 bp, Artificial Sequence
  sgRNA
  NTC_727
gcgcaatgtgctatcccgaa

SEQ ID NO: 65475 - DNA, 20 bp, Artificial Sequence
  sgRNA
  NTC_728
cgttaacacgtctcgatacc

SEQ ID NO: 65476 - DNA, 20 bp, Artificial Sequence
  sgRNA
  NTC_729
gcggttactaggacacgttc

SEQ ID NO: 65477 - DNA, 20 bp, Artificial Sequence
  sgRNA
  NTC_730
gattgcgcggtctcgactgt

SEQ ID NO: 65478 - DNA, 20 bp, Artificial Sequence
  sgRNA
  NTC_731
tcgtatcggcggtcacaata

SEQ ID NO: 65479 - DNA, 20 bp, Artificial Sequence
  sgRNA
  NTC_732
gacgaacgttatcgtactct

SEQ ID NO: 65480 - DNA, 20 bp, Artificial Sequence
  sgRNA
  NTC_733
gcgtaggtgacgatcgcttc

SEQ ID NO: 65481 - DNA, 20 bp, Artificial Sequence
  sgRNA
  NTC_734
ataacgaatggcgtgtatag

SEQ ID NO: 65482 - DNA, 20 bp, Artificial Sequence
  sgRNA
  NTC_735
ggcgcggttgacgtcgcatg

SEQ ID NO: 65483 - DNA, 20 bp, Artificial Sequence
  sgRNA
  NTC_736
gctagcgtggtgtgcgaaag

SEQ ID NO: 65484 - DNA, 20 bp, Artificial Sequence
  sgRNA
  NTC_737
agcgaggtgcattacgccgc

SEQ ID NO: 65485 - DNA, 20 bp, Artificial Sequence
  sgRNA
  NTC_738
aagctttcgtataccgatct

SEQ ID NO: 65486 - DNA, 20 bp, Artificial Sequence
  sgRNA
  NTC_739
atctgtaacgcgccacgcgt

SEQ ID NO: 65487 - DNA, 20 bp, Artificial Sequence
  sgRNA
  NTC_740
gcggagtgcaattcgctacc

SEQ ID NO: 65488 - DNA, 20 bp, Artificial Sequence
  sgRNA
  NTC_741
cgctgtcaatcgctaccgtc

SEQ ID NO: 65489 - DNA, 20 bp, Artificial Sequence
  sgRNA
  NTC_742
gtatcacgcgaatctagccg

SEQ ID NO: 65490 - DNA, 20 bp, Artificial Sequence
  sgRNA
  NTC_743
gcacggcgtcaaaccgcatc

SEQ ID NO: 65491 - DNA, 20 bp, Artificial Sequence
  sgRNA
  NTC_744
tgtcacgattgacgaagacg

SEQ ID NO: 65492 - DNA, 20 bp, Artificial Sequence
  sgRNA
  NTC_745
tacagtaattcgctcgataa

SEQ ID NO: 65493 - DNA, 20 bp, Artificial Sequence
  sgRNA
  NTC_746
caggctgcggattacgtgcg

SEQ ID NO: 65494 - DNA, 20 bp, Artificial Sequence
  sgRNA
  NTC_747
ttgtcgactgcgaccgtaat

SEQ ID NO: 65495 - DNA, 20 bp, Artificial Sequence
  sgRNA
  NTC_748
ggcagatcactaacgacgcc

SEQ ID NO: 65496 - DNA, 20 bp, Artificial Sequence
  sgRNA
  NTC_749
actataatgcgcttaaacgc

SEQ ID NO: 65497 - DNA, 20 bp, Artificial Sequence
  sgRNA
  NTC_750
gtacgagtttcgacgccaaa

SEQ ID NO: 65498 - DNA, 20 bp, Artificial Sequence
  sgRNA
  NTC_751
gaaggtgtgtctcgcgcacg

SEQ ID NO: 65499 - DNA, 20 bp, Artificial Sequence
  sgRNA
  NTC_752
acgcatcacgtccatacatc

SEQ ID NO: 65500 - DNA, 20 bp, Artificial Sequence
  sgRNA
  NTC_753
gggcatagatcgtcgcgatc

SEQ ID NO: 65501 - DNA, 20 bp, Artificial Sequence
  sgRNA
  NTC_754
gaattggcgactacccgagt

SEQ ID NO: 65502 - DNA, 20 bp, Artificial Sequence
  sgRNA
  NTC_755
ggactgttgatccgtaccta

SEQ ID NO: 65503 - DNA, 20 bp, Artificial Sequence
  sgRNA
  NTC_756
ttcacggtcacacccgtcgt

SEQ ID NO: 65504 - DNA, 20 bp, Artificial Sequence
  sgRNA
  NTC_757
gagtcgaatatgcgattact

SEQ ID NO: 65505 - DNA, 20 bp, Artificial Sequence
  sgRNA
  NTC_758
atgaattaacgttccgtacg

SEQ ID NO: 65506 - DNA, 20 bp, Artificial Sequence
  sgRNA
  NTC_759
atgacgctcgtatgcgcatc

SEQ ID NO: 65507 - DNA, 20 bp, Artificial Sequence
  sgRNA
  NTC_760
gttgagggcgtattaccgtc

SEQ ID NO: 65508 - DNA, 20 bp, Artificial Sequence
  sgRNA
  NTC_761
gtcgatcgaacacgcgagct

SEQ ID NO: 65509 - DNA, 20 bp, Artificial Sequence
  sgRNA
  NTC_762
aaagactacgcgcgtacgat

SEQ ID NO: 65510 - DNA, 20 bp, Artificial Sequence
  sgRNA
  NTC_763
cttaatgcggtcgacgagct

SEQ ID NO: 65511 - DNA, 20 bp, Artificial Sequence
  sgRNA
  NTC_764
tctggtatgcaaccgcttac

SEQ ID NO: 65512 - DNA, 20 bp, Artificial Sequence
  sgRNA
  NTC_765
atatggttatcgtacgatcg

SEQ ID NO: 65513 - DNA, 20 bp, Artificial Sequence
  sgRNA
  NTC_766
tgttcgtttcggtacgcgcc

SEQ ID NO: 65514 - DNA, 20 bp, Artificial Sequence
  sgRNA
  NTC_767
ttctggacaatcgcgcaagc

SEQ ID NO: 65515 - DNA, 20 bp, Artificial Sequence
  sgRNA
  NTC_768
gaggcgcgcgtaaccacaat

SEQ ID NO: 65516 - DNA, 20 bp, Artificial Sequence
  sgRNA
  NTC_769
tcgcgagtgtactattacgc

SEQ ID NO: 65517 - DNA, 20 bp, Artificial Sequence
  sgRNA
  NTC_770
ggtgtcgtcttgcgcgatcg

SEQ ID NO: 65518 - DNA, 20 bp, Artificial Sequence
  sgRNA
  NTC_771
gaggacataacgtcccgatt

SEQ ID NO: 65519 - DNA, 20 bp, Artificial Sequence
  sgRNA
  NTC_772
gacgcgagtctttacgatct

SEQ ID NO: 65520 - DNA, 20 bp, Artificial Sequence
  sgRNA
  NTC_773
aggatatcggaacgcgccct

SEQ ID NO: 65521 - DNA, 20 bp, Artificial Sequence
  sgRNA
  NTC_774
ggagtactcgacgatcagaa

SEQ ID NO: 65522 - DNA, 20 bp, Artificial Sequence
  sgRNA
  NTC_775
tcacattatcattgcgacgc

SEQ ID NO: 65523 - DNA, 20 bp, Artificial Sequence
  sgRNA
  NTC_776
gtggacgggattactagacg

SEQ ID NO: 65524 - DNA, 20 bp, Artificial Sequence
  sgRNA
  NTC_777
ttatcaattaaacgcgacac

SEQ ID NO: 65525 - DNA, 20 bp, Artificial Sequence
  sgRNA
  NTC_778
cgtacgtgcatgaaccgcaa

SEQ ID NO: 65526 - DNA, 20 bp, Artificial Sequence
  sgRNA
  NTC_779
gcgaaaaatcgcgctcttct

SEQ ID NO: 65527 - DNA, 20 bp, Artificial Sequence
  sgRNA
  NTC_780
gcgttcggggtaaatgcgcg

SEQ ID NO: 65528 - DNA, 20 bp, Artificial Sequence
  sgRNA
  NTC_781
tgcgtactgcatactcgatc

SEQ ID NO: 65529 - DNA, 20 bp, Artificial Sequence
  sgRNA
  NTC_782
cgcgctcgaatatagctagc

SEQ ID NO: 65530 - DNA, 20 bp, Artificial Sequence
  sgRNA
  NTC_783
tattcgcatcgtttcgtatg

SEQ ID NO: 65531 - DNA, 20 bp, Artificial Sequence
  sgRNA
  NTC_784
cggtctacgagccgtcctat

SEQ ID NO: 65532 - DNA, 20 bp, Artificial Sequence
  sgRNA
  NTC_785
cgtaatgatcgcaccgcccg

SEQ ID NO: 65533 - DNA, 20 bp, Artificial Sequence
  sgRNA
  NTC_786
gcaggtgagacgaccgacgt

SEQ ID NO: 65534 - DNA, 20 bp, Artificial Sequence
  sgRNA
  NTC_787
tggcacttgtcgaccgaatt

SEQ ID NO: 65535 - DNA, 20 bp, Artificial Sequence
  sgRNA
  NTC_788
tgacgtttcgcgacagttac

SEQ ID NO: 65536 - DNA, 20 bp, Artificial Sequence
  sgRNA
  NTC_789
gaaggctactacgccgatga

SEQ ID NO: 65537 - DNA, 20 bp, Artificial Sequence
  sgRNA
  NTC_790
tgacgcggctaattacacga

SEQ ID NO: 65538 - DNA, 20 bp, Artificial Sequence
  sgRNA
  NTC_791
tattctcgatcaccgatata

SEQ ID NO: 65539 - DNA, 20 bp, Artificial Sequence
  sgRNA
  NTC_792
tgaacacggattgcgcgaga

SEQ ID NO: 65540 - DNA, 20 bp, Artificial Sequence
  sgRNA
  NTC_793
aatagagtcgcgaccgcctt

SEQ ID NO: 65541 - DNA, 20 bp, Artificial Sequence
  sgRNA
  NTC_794
ggaattgatgggatcgacac

SEQ ID NO: 65542 - DNA, 20 bp, Artificial Sequence
  sgRNA
  NTC_795
catctcttcaagcgcataac

SEQ ID NO: 65543 - DNA, 20 bp, Artificial Sequence
  sgRNA
  NTC_796
gggctatacggcagtcacgc

SEQ ID NO: 65544 - DNA, 20 bp, Artificial Sequence
  sgRNA
  NTC_797
ggtcagtaagtgccgaaccg

SEQ ID NO: 65545 - DNA, 20 bp, Artificial Sequence
  sgRNA
  NTC_798
gtcaattcgtcgccatacgc

SEQ ID NO: 65546 - DNA, 20 bp, Artificial Sequence
  sgRNA
  NTC_799
acgcactcgcttatcgcata

SEQ ID NO: 65547 - DNA, 20 bp, Artificial Sequence
  sgRNA
  NTC_800
agaactcggcggatgccgat

SEQ ID NO: 65548 - DNA, 20 bp, Artificial Sequence
  sgRNA
  NTC_801
acacggcgggcatgtataca

SEQ ID NO: 65549 - DNA, 20 bp, Artificial Sequence
  sgRNA
  NTC_802
tcgctaggacgtgcgttgta

SEQ ID NO: 65550 - DNA, 20 bp, Artificial Sequence
  sgRNA
  NTC_803
acacgatcgacgctaacgag

SEQ ID NO: 65551 - DNA, 20 bp, Artificial Sequence
  sgRNA
  NTC_804
cggcgagatcgaaaacgtgt

SEQ ID NO: 65552 - DNA, 20 bp, Artificial Sequence
  sgRNA
  NTC_805
tcgcaagcggcgtgcatatg

SEQ ID NO: 65553 - DNA, 20 bp, Artificial Sequence
  sgRNA
  NTC_806
gacgaactaatcgctccgca

SEQ ID NO: 65554 - DNA, 20 bp, Artificial Sequence
  sgRNA
  NTC_807
tcaagctaaatcgttcgtat

SEQ ID NO: 65555 - DNA, 20 bp, Artificial Sequence
  sgRNA
  NTC_808
gacggcggtacgttgtcgaa

SEQ ID NO: 65556 - DNA, 20 bp, Artificial Sequence
  sgRNA
  NTC_809
cgtgattcatcgtacgaact

SEQ ID NO: 65557 - DNA, 20 bp, Artificial Sequence
  sgRNA
  NTC_810
ttgttatttcggtcgacagc

SEQ ID NO: 65558 - DNA, 20 bp, Artificial Sequence
  sgRNA
  NTC_811
atctacgtctacgcgaagcg

SEQ ID NO: 65559 - DNA, 20 bp, Artificial Sequence
  sgRNA
  NTC_812
tgcttgttaacgcagcgaat

SEQ ID NO: 65560 - DNA, 20 bp, Artificial Sequence
  sgRNA
  NTC_813
gctacgcgtagatctcgcct

SEQ ID NO: 65561 - DNA, 20 bp, Artificial Sequence
  sgRNA
  NTC_814
tgtacgaatgcgttcgataa

SEQ ID NO: 65562 - DNA, 20 bp, Artificial Sequence
  sgRNA
  NTC_815
agaagtacgtacgcgctagt

SEQ ID NO: 65563 - DNA, 20 bp, Artificial Sequence
  sgRNA
  NTC_816
tcgtgcaacggtcatcgacg

SEQ ID NO: 65564 - DNA, 20 bp, Artificial Sequence
  sgRNA
  NTC_817
cgtaaatttacgcacgtacg

SEQ ID NO: 65565 - DNA, 20 bp, Artificial Sequence
  sgRNA
  NTC_818
ctttcgatcgcgtacacgtt

SEQ ID NO: 65566 - DNA, 20 bp, Artificial Sequence
  sgRNA
  NTC_819
agcgctggatgcgtcacgca

SEQ ID NO: 65567 - DNA, 20 bp, Artificial Sequence
  sgRNA
  NTC_820
atcgtgcatcacgccatata

SEQ ID NO: 65568 - DNA, 20 bp, Artificial Sequence
  sgRNA
  NTC_821
tgggattgatactcgctaag

SEQ ID NO: 65569 - DNA, 20 bp, Artificial Sequence
  sgRNA
  NTC_822
gaatagagcgcttccgttgt

SEQ ID NO: 65570 - DNA, 20 bp, Artificial Sequence
  sgRNA
  NTC_823
agtatgtgggatcgcgcaac

SEQ ID NO: 65571 - DNA, 20 bp, Artificial Sequence
  sgRNA
  NTC_824
aaacgcatttcgagcccgca

SEQ ID NO: 65572 - DNA, 20 bp, Artificial Sequence
  sgRNA
  NTC_825
ataaggcactagcgctatcg

SEQ ID NO: 65573 - DNA, 20 bp, Artificial Sequence
  sgRNA
  NTC_826
tacgtcatcgtccgcgcaca

SEQ ID NO: 65574 - DNA, 20 bp, Artificial Sequence
  sgRNA
  NTC_827
aacgtgtggcgccaacgcac

SEQ ID NO: 65575 - DNA, 20 bp, Artificial Sequence
  sgRNA
  NTC_828
gctgatgcgtcatccgatta

SEQ ID NO: 65576 - DNA, 20 bp, Artificial Sequence
  sgRNA
  NTC_829
taaaggctcgcgtcccgtct

SEQ ID NO: 65577 - DNA, 20 bp, Artificial Sequence
  sgRNA
  NTC_830
gtgtggagcgcacccgcata

SEQ ID NO: 65578 - DNA, 20 bp, Artificial Sequence
  sgRNA
  NTC_831
gtgacgcaattcacgtcgcg

SEQ ID NO: 65579 - DNA, 20 bp, Artificial Sequence
  sgRNA
  NTC_832
tcgatcgtctgcgcgccgta

SEQ ID NO: 65580 - DNA, 20 bp, Artificial Sequence
  sgRNA
  NTC_833
aaggttatgcggttatcgcg

SEQ ID NO: 65581 - DNA, 20 bp, Artificial Sequence
  sgRNA
  NTC_834
ttctggatcgcacgcgttcg

SEQ ID NO: 65582 - DNA, 20 bp, Artificial Sequence
  sgRNA
  NTC_835
gagtattagtatcgtgtcgt

SEQ ID NO: 65583 - DNA, 20 bp, Artificial Sequence
  sgRNA
  NTC_836
acgtaacgaaacgccctgcc

SEQ ID NO: 65584 - DNA, 20 bp, Artificial Sequence
  sgRNA
  NTC_837
cgatagcgtactgtcgttcg

SEQ ID NO: 65585 - DNA, 20 bp, Artificial Sequence
  sgRNA
  NTC_838
ttactcgtggacgccgcaat

SEQ ID NO: 65586 - DNA, 20 bp, Artificial Sequence
  sgRNA
  NTC_839
gagtgcgtacgatcaaccta

SEQ ID NO: 65587 - DNA, 20 bp, Artificial Sequence
  sgRNA
  NTC_840
gcggactcgatacgaatgtc

SEQ ID NO: 65588 - DNA, 20 bp, Artificial Sequence
  sgRNA
  NTC_841
gtcgcgacgtacttagcgac

SEQ ID NO: 65589 - DNA, 20 bp, Artificial Sequence
  sgRNA
  NTC_842
cacggtgcactaccgtcgca

SEQ ID NO: 65590 - DNA, 20 bp, Artificial Sequence
  sgRNA
  NTC_843
acgggcggatcgcgacacga

SEQ ID NO: 65591 - DNA, 20 bp, Artificial Sequence
  sgRNA
  NTC_844
gtatttcacgcaatttcgcg

SEQ ID NO: 65592 - DNA, 20 bp, Artificial Sequence
  sgRNA
  NTC_845
gcgacggtgtcgcacacgac

SEQ ID NO: 65593 - DNA, 20 bp, Artificial Sequence
  sgRNA
  NTC_846
ttacgcgtcgactaagctag

SEQ ID NO: 65594 - DNA, 20 bp, Artificial Sequence
  sgRNA
  NTC_847
tacggagggtcgtttcgctc

SEQ ID NO: 65595 - DNA, 20 bp, Artificial Sequence
  sgRNA
  NTC_848
gggtaacgcgacgttgccgt

SEQ ID NO: 65596 - DNA, 20 bp, Artificial Sequence
  sgRNA
  NTC_849
gcgttggcgggacgtaatcc

SEQ ID NO: 65597 - DNA, 20 bp, Artificial Sequence
  sgRNA
  NTC_850
tagcgctaacatagcgcatc

SEQ ID NO: 65598 - DNA, 20 bp, Artificial Sequence
  sgRNA
  NTC_851
gtcacaaatcgtatctaccg

SEQ ID NO: 65599 - DNA, 20 bp, Artificial Sequence
  sgRNA
  NTC_852
ttaggcgcgcacgtagatga

SEQ ID NO: 65600 - DNA, 20 bp, Artificial Sequence
  sgRNA
  NTC_853
gtcgtacacgcgttaagcag

SEQ ID NO: 65601 - DNA, 20 bp, Artificial Sequence
  sgRNA
  NTC_854
taatattacgcaccgctgcg

SEQ ID NO: 65602 - DNA, 20 bp, Artificial Sequence
  sgRNA
  NTC_855
gctcgtaaatctcgagtagc

SEQ ID NO: 65603 - DNA, 20 bp, Artificial Sequence
  sgRNA
  NTC_856
atggttaacagcgtttagcg

SEQ ID NO: 65604 - DNA, 20 bp, Artificial Sequence
  sgRNA
  NTC_857
gcgctactcgcacgaccttt

SEQ ID NO: 65605 - DNA, 20 bp, Artificial Sequence
  sgRNA
  NTC_858
gcgagatcatcaataagcgc

SEQ ID NO: 65606 - DNA, 20 bp, Artificial Sequence
  sgRNA
  NTC_859
cgcgcaactcggtttgcgct

SEQ ID NO: 65607 - DNA, 20 bp, Artificial Sequence
  sgRNA
  NTC_860
tcgttgacgtggccgcacgc

SEQ ID NO: 65608 - DNA, 20 bp, Artificial Sequence
  sgRNA
  NTC_861
tggcgtatagcgtgacaacg

SEQ ID NO: 65609 - DNA, 20 bp, Artificial Sequence
  sgRNA
  NTC_862
ggtttcggactagccgaatc

SEQ ID NO: 65610 - DNA, 20 bp, Artificial Sequence
  sgRNA
  NTC_863
ttaggtggcgtgtatcgtag

SEQ ID NO: 65611 - DNA, 20 bp, Artificial Sequence
  sgRNA
  NTC_864
gtggggaagtacgcgcccga

SEQ ID NO: 65612 - DNA, 20 bp, Artificial Sequence
  sgRNA
  NTC_865
cgcgttcttgaacccgatac

SEQ ID NO: 65613 - DNA, 20 bp, Artificial Sequence
  sgRNA
  NTC_866
tcatcgcggcggttaaattc

SEQ ID NO: 65614 - DNA, 20 bp, Artificial Sequence
  sgRNA
  NTC_867
tcgtatgagctagacgtaac

SEQ ID NO: 65615 - DNA, 20 bp, Artificial Sequence
  sgRNA
  NTC_868
agtacgacgtcgacattatc

SEQ ID NO: 65616 - DNA, 20 bp, Artificial Sequence
  sgRNA
  NTC_869
ctatgcgaacgttcgcaaga

SEQ ID NO: 65617 - DNA, 20 bp, Artificial Sequence
  sgRNA
  NTC_870
agcgcgttagtctactacta

SEQ ID NO: 65618 - DNA, 20 bp, Artificial Sequence
  sgRNA
  NTC_871
ctatacggacattccgacta

SEQ ID NO: 65619 - DNA, 20 bp, Artificial Sequence
  sgRNA
  NTC_872
gtacgcatcatgtccgacat

SEQ ID NO: 65620 - DNA, 20 bp, Artificial Sequence
  sgRNA
  NTC_873
cgacaggaaacgataccgcg

SEQ ID NO: 65621 - DNA, 20 bp, Artificial Sequence
  sgRNA
  NTC_874
ctagctcggcgattaacgtc

SEQ ID NO: 65622 - DNA, 20 bp, Artificial Sequence
  sgRNA
  NTC_875
ggcgacgtgctaaaatcccc

SEQ ID NO: 65623 - DNA, 20 bp, Artificial Sequence
  sgRNA
  NTC_876
cggttcagcacgtgtcgaca

SEQ ID NO: 65624 - DNA, 20 bp, Artificial Sequence
  sgRNA
  NTC_877
ttggattgataacgcgacag

SEQ ID NO: 65625 - DNA, 20 bp, Artificial Sequence
  sgRNA
  NTC_878
gttagatcgtctatcacgat

SEQ ID NO: 65626 - DNA, 20 bp, Artificial Sequence
  sgRNA
  NTC_879
tcggtaatcgcagtccgttc

SEQ ID NO: 65627 - DNA, 20 bp, Artificial Sequence
  sgRNA
  NTC_880
ggctctgacacgcgtagata

SEQ ID NO: 65628 - DNA, 20 bp, Artificial Sequence
  sgRNA
  NTC_881
gacgttaggatacgcgaata

SEQ ID NO: 65629 - DNA, 20 bp, Artificial Sequence
  sgRNA
  NTC_882
atgatttgtagtgacgcgat

SEQ ID NO: 65630 - DNA, 20 bp, Artificial Sequence
  sgRNA
  NTC_883
tcgaggatcgtagttcgatg

SEQ ID NO: 65631 - DNA, 20 bp, Artificial Sequence
  sgRNA
  NTC_884
catcgttcgcacgcgcgctc

SEQ ID NO: 65632 - DNA, 20 bp, Artificial Sequence
  sgRNA
  NTC_885
atgaggtgcgggccgcctaa

SEQ ID NO: 65633 - DNA, 20 bp, Artificial Sequence
  sgRNA
  NTC_886
aacgtaatatttgcgcgatt

SEQ ID NO: 65634 - DNA, 20 bp, Artificial Sequence
  sgRNA
  NTC_887
gggcacgaacgaaatacgcc

SEQ ID NO: 65635 - DNA, 20 bp, Artificial Sequence
  sgRNA
  NTC_888
aagtgcttgacgacgaacaa

SEQ ID NO: 65636 - DNA, 20 bp, Artificial Sequence
  sgRNA
  NTC_889
cgggcgagcttaccgtaagt

SEQ ID NO: 65637 - DNA, 20 bp, Artificial Sequence
  sgRNA
  NTC_890
ttacgacgttcgttgacgca

SEQ ID NO: 65638 - DNA, 20 bp, Artificial Sequence
  sgRNA
  NTC_891
ggtgcagcagaacctacgta

SEQ ID NO: 65639 - DNA, 20 bp, Artificial Sequence
  sgRNA
  NTC_892
taggataatggccccgatac

SEQ ID NO: 65640 - DNA, 20 bp, Artificial Sequence
  sgRNA
  NTC_893
ggtgctagaactcgatacga

SEQ ID NO: 65641 - DNA, 20 bp, Artificial Sequence
  sgRNA
  NTC_894
catcgcgtattcgttgagcg

SEQ ID NO: 65642 - DNA, 20 bp, Artificial Sequence
  sgRNA
  NTC_895
gatgctggtcgattcgtact

SEQ ID NO: 65643 - DNA, 20 bp, Artificial Sequence
  sgRNA
  NTC_896
actaacgtaagcttcgcccg

SEQ ID NO: 65644 - DNA, 20 bp, Artificial Sequence
  sgRNA
  NTC_897
tatgacttgaacctccgctt

SEQ ID NO: 65645 - DNA, 20 bp, Artificial Sequence
  sgRNA
  NTC_898
aggtattcgggaacgccgtt

SEQ ID NO: 65646 - DNA, 20 bp, Artificial Sequence
  sgRNA
  NTC_899
cgtgatcgcgtgtacgtaac

SEQ ID NO: 65647 - DNA, 20 bp, Artificial Sequence
  sgRNA
  NTC_900
ggcggtgtgcgaatgaacgc

SEQ ID NO: 65648 - DNA, 20 bp, Artificial Sequence
  sgRNA
  NTC_901
attattgcgacactcgcaac

SEQ ID NO: 65649 - DNA, 20 bp, Artificial Sequence
  sgRNA
  NTC_902
gtggatcgtaatacgcagat

SEQ ID NO: 65650 - DNA, 20 bp, Artificial Sequence
  sgRNA
  NTC_903
attgacgttatcatcgatcg

SEQ ID NO: 65651 - DNA, 20 bp, Artificial Sequence
  sgRNA
  NTC_904
acggttctttcgcttaattc

SEQ ID NO: 65652 - DNA, 20 bp, Artificial Sequence
  sgRNA
  NTC_905
cgatcgtcgcagcatcgcgt

SEQ ID NO: 65653 - DNA, 20 bp, Artificial Sequence
  sgRNA
  NTC_906
ggcacgtaagcttgacgcgc

SEQ ID NO: 65654 - DNA, 20 bp, Artificial Sequence
  sgRNA
  NTC_907
tgctttcgattaacatcgac

SEQ ID NO: 65655 - DNA, 20 bp, Artificial Sequence
  sgRNA
  NTC_908
acgcgagttgagccgaatcc

SEQ ID NO: 65656 - DNA, 20 bp, Artificial Sequence
  sgRNA
  NTC_909
tcacgaacggattcccgcgt

SEQ ID NO: 65657 - DNA, 20 bp, Artificial Sequence
  sgRNA
  NTC_910
actgttaagtcgcgacgccc

SEQ ID NO: 65658 - DNA, 20 bp, Artificial Sequence
  sgRNA
  NTC_911
gtctagacggtcacgtcgcg

SEQ ID NO: 65659 - DNA, 20 bp, Artificial Sequence
  sgRNA
  NTC_912
tagcgatgagtgccacgatt

SEQ ID NO: 65660 - DNA, 20 bp, Artificial Sequence
  sgRNA
  NTC_913
gctgcacttgtttgcgcgat

SEQ ID NO: 65661 - DNA, 20 bp, Artificial Sequence
  sgRNA
  NTC_914
aatgagtattcgccgctcgc

SEQ ID NO: 65662 - DNA, 20 bp, Artificial Sequence
  sgRNA
  NTC_915
aaactcgtcgcgcgaactat

SEQ ID NO: 65663 - DNA, 20 bp, Artificial Sequence
  sgRNA
  NTC_916
acgaatgtagggcgcgttag

SEQ ID NO: 65664 - DNA, 20 bp, Artificial Sequence
  sgRNA
  NTC_917
cacttaacgacgccaagata

SEQ ID NO: 65665 - DNA, 20 bp, Artificial Sequence
  sgRNA
  NTC_918
agacggcgaacgcgttgttt

SEQ ID NO: 65666 - DNA, 20 bp, Artificial Sequence
  sgRNA
  NTC_919
tacgcggtcgtcgtccatcg

SEQ ID NO: 65667 - DNA, 20 bp, Artificial Sequence
  sgRNA
  NTC_920
gaaacgactaagcgcgagtc

SEQ ID NO: 65668 - DNA, 20 bp, Artificial Sequence
  sgRNA
  NTC_921
cgacgcactttgactcgcaa

SEQ ID NO: 65669 - DNA, 20 bp, Artificial Sequence
  sgRNA
  NTC_922
tggtcgggtcaatccgctgc

SEQ ID NO: 65670 - DNA, 20 bp, Artificial Sequence
  sgRNA
  NTC_923
ctcgtgtgcgcgtatacagc

SEQ ID NO: 65671 - DNA, 20 bp, Artificial Sequence
  sgRNA
  NTC_924
tcgaacgtacagtagcgatc

SEQ ID NO: 65672 - DNA, 20 bp, Artificial Sequence
  sgRNA
  NTC_925
gcgtcaaagtatgctaagtc

SEQ ID NO: 65673 - DNA, 20 bp, Artificial Sequence
  sgRNA
  NTC_926
gcaaagtacggctcgtcgac

SEQ ID NO: 65674 - DNA, 20 bp, Artificial Sequence
  sgRNA
  NTC_927
ttcactacttatagcgacgt

SEQ ID NO: 65675 - DNA, 20 bp, Artificial Sequence
  sgRNA
  NTC_928
gtttcgtgcgatcgccgccg

SEQ ID NO: 65676 - DNA, 20 bp, Artificial Sequence
  sgRNA
  NTC_929
cgtaatcgcagtgcgtctaa

SEQ ID NO: 65677 - DNA, 20 bp, Artificial Sequence
  sgRNA
  NTC_930
cgttcgcgggctacaacgtg

SEQ ID NO: 65678 - DNA, 20 bp, Artificial Sequence
  sgRNA
  NTC_931
ggcgctagtgtacgattaaa

SEQ ID NO: 65679 - DNA, 20 bp, Artificial Sequence
  sgRNA
  NTC_932
cgttgtagcgaacgtactat

SEQ ID NO: 65680 - DNA, 20 bp, Artificial Sequence
  sgRNA
  NTC_933
ctgtcgggcgacccgacgag

SEQ ID NO: 65681 - DNA, 20 bp, Artificial Sequence
  sgRNA
  NTC_934
acaaaggatacttgcgcccg

SEQ ID NO: 65682 - DNA, 20 bp, Artificial Sequence
  sgRNA
  NTC_935
ctgtcgtatgcgtcgacgca

SEQ ID NO: 65683 - DNA, 20 bp, Artificial Sequence
  sgRNA
  NTC_936
gggtatcgtaagttagaccg

SEQ ID NO: 65684 - DNA, 20 bp, Artificial Sequence
  sgRNA
  NTC_937
cgacgggttcgacgttcaat

SEQ ID NO: 65685 - DNA, 20 bp, Artificial Sequence
  sgRNA
  NTC_938
cgacagctttatacgcgtta

SEQ ID NO: 65686 - DNA, 20 bp, Artificial Sequence
  sgRNA
  NTC_939
tgcacgcttacatccaattc

SEQ ID NO: 65687 - DNA, 20 bp, Artificial Sequence
  sgRNA
  NTC_940
taatggggtcgcgccaatcg

SEQ ID NO: 65688 - DNA, 20 bp, Artificial Sequence
  sgRNA
  NTC_941
tcgcactgagcgcgccaact

SEQ ID NO: 65689 - DNA, 20 bp, Artificial Sequence
  sgRNA
  NTC_942
tgataaggggcgctgcgctc

SEQ ID NO: 65690 - DNA, 20 bp, Artificial Sequence
  sgRNA
  NTC_943
gttacgggagtcgacgtcca

SEQ ID NO: 65691 - DNA, 20 bp, Artificial Sequence
  sgRNA
  NTC_944
ctatgtcggcgctcaaccgt

SEQ ID NO: 65692 - DNA, 20 bp, Artificial Sequence
  sgRNA
  NTC_945
gttagggcgattgccgccac

SEQ ID NO: 65693 - DNA, 20 bp, Artificial Sequence
  sgRNA
  NTC_946
tgggtttcgcgcgacatact

SEQ ID NO: 65694 - DNA, 20 bp, Artificial Sequence
  sgRNA
  NTC_947
ggggcgcgttcgtataataa

SEQ ID NO: 65695 - DNA, 20 bp, Artificial Sequence
  sgRNA
  NTC_948
tactcgtgctaagtccgacg

SEQ ID NO: 65696 - DNA, 20 bp, Artificial Sequence
  sgRNA
  NTC_949
aacggaatgctcgtcgcgat

SEQ ID NO: 65697 - DNA, 20 bp, Artificial Sequence
  sgRNA
  NTC_950
aatacgcgcgttcctcgcat

SEQ ID NO: 65698 - DNA, 20 bp, Artificial Sequence
  sgRNA
  NTC_951
gatatactcgcgcgatcaca

SEQ ID NO: 65699 - DNA, 20 bp, Artificial Sequence
  sgRNA
  NTC_952
gcgtgacgcgaccgatcgcc

SEQ ID NO: 65700 - DNA, 20 bp, Artificial Sequence
  sgRNA
  NTC_953
ggtatcagttcgcgtaagtc

SEQ ID NO: 65701 - DNA, 20 bp, Artificial Sequence
  sgRNA
  NTC_954
ttcggagctggttccgaatc

SEQ ID NO: 65702 - DNA, 20 bp, Artificial Sequence
  sgRNA
  NTC_955
cgctcgatgggactaatgcg

SEQ ID NO: 65703 - DNA, 20 bp, Artificial Sequence
  sgRNA
  NTC_956
gcgcatcaatttaacacgta

SEQ ID NO: 65704 - DNA, 20 bp, Artificial Sequence
  sgRNA
  NTC_957
gtcgtatgtacgttatacga

SEQ ID NO: 65705 - DNA, 20 bp, Artificial Sequence
  sgRNA
  NTC_958
tcgcaacaggtctaccgtta

SEQ ID NO: 65706 - DNA, 20 bp, Artificial Sequence
  sgRNA
  NTC_959
gagtcgcgcgagcgttacgt

SEQ ID NO: 65707 - DNA, 20 bp, Artificial Sequence
  sgRNA
  NTC_960
aaacgcgtaatcaatcgatc

SEQ ID NO: 65708 - DNA, 20 bp, Artificial Sequence
  sgRNA
  NTC_961
gctcgggattagccgtcatc

SEQ ID NO: 65709 - DNA, 20 bp, Artificial Sequence
  sgRNA
  NTC_962
catgcgtcaacgtagtcgcg

SEQ ID NO: 65710 - DNA, 20 bp, Artificial Sequence
  sgRNA
  NTC_963
ttcgcggggtcgtataccac

SEQ ID NO: 65711 - DNA, 20 bp, Artificial Sequence
  sgRNA
  NTC_964
ttgtatggttcgacgacgtg

SEQ ID NO: 65712 - DNA, 20 bp, Artificial Sequence
  sgRNA
  NTC_965
gcaagtaacatcgcgcgtct

SEQ ID NO: 65713 - DNA, 20 bp, Artificial Sequence
  sgRNA
  NTC_966
agcgtcggttgtatcgagtc

SEQ ID NO: 65714 - DNA, 20 bp, Artificial Sequence
  sgRNA
  NTC_967
atcataaggtcttacgcgcc

SEQ ID NO: 65715 - DNA, 20 bp, Artificial Sequence
  sgRNA
  NTC_968
tcgcgtattctacatcgcct

SEQ ID NO: 65716 - DNA, 20 bp, Artificial Sequence
  sgRNA
  NTC_969
gtcgtacgcgagttgttgtt

SEQ ID NO: 65717 - DNA, 20 bp, Artificial Sequence
  sgRNA
  NTC_970
gattgcgatatctcgacgct

SEQ ID NO: 65718 - DNA, 20 bp, Artificial Sequence
  sgRNA
  NTC_971
tgcatgattgaccatacgcg

SEQ ID NO: 65719 - DNA, 20 bp, Artificial Sequence
  sgRNA
  NTC_972
cggaacgagtgccgcaacgc

SEQ ID NO: 65720 - DNA, 20 bp, Artificial Sequence
  sgRNA
  NTC_973
agaacggtcagccgaccgtc

SEQ ID NO: 65721 - DNA, 20 bp, Artificial Sequence
  sgRNA
  NTC_974
ggatcgtgtttgcgccaccg

SEQ ID NO: 65722 - DNA, 20 bp, Artificial Sequence
  sgRNA
  NTC_975
ggagcgcgctatcttacgat

SEQ ID NO: 65723 - DNA, 20 bp, Artificial Sequence
  sgRNA
  NTC_976
aagttggcggaccacgcgta

SEQ ID NO: 65724 - DNA, 20 bp, Artificial Sequence
  sgRNA
  NTC_977
tcgagtacttgacgcgtatc

SEQ ID NO: 65725 - DNA, 20 bp, Artificial Sequence
  sgRNA
  NTC_978
aggcgttcggacatacgtaa

SEQ ID NO: 65726 - DNA, 20 bp, Artificial Sequence
  sgRNA
  NTC_979
ctacgtcttagtgcgatcgt

SEQ ID NO: 65727 - DNA, 20 bp, Artificial Sequence
  sgRNA
  NTC_980
cgtttgtacaagtttcgacg

SEQ ID NO: 65728 - DNA, 20 bp, Artificial Sequence
  sgRNA
  NTC_981
gggtaaatatcatactatcg

SEQ ID NO: 65729 - DNA, 20 bp, Artificial Sequence
  sgRNA
  NTC_982
gcgcagtcattgccgactac

SEQ ID NO: 65730 - DNA, 20 bp, Artificial Sequence
  sgRNA
  NTC_983
ggagctattacgtactcgta

SEQ ID NO: 65731 - DNA, 20 bp, Artificial Sequence
  sgRNA
  NTC_984
ggtagatacggatcgtcacg

SEQ ID NO: 65732 - DNA, 20 bp, Artificial Sequence
  sgRNA
  NTC_985
tgtacggtgcaccgcgcgtc

SEQ ID NO: 65733 - DNA, 20 bp, Artificial Sequence
  sgRNA
  NTC_986
gggaatggtgtaactatccg

SEQ ID NO: 65734 - DNA, 20 bp, Artificial Sequence
  sgRNA
  NTC_987
agtcacaatacgcattaatc

SEQ ID NO: 65735 - DNA, 20 bp, Artificial Sequence
  sgRNA
  NTC_988
gcgaggacgtcgctacgtct

SEQ ID NO: 65736 - DNA, 20 bp, Artificial Sequence
  sgRNA
  NTC_989
ttgcgtgcgatcgaactacg

SEQ ID NO: 65737 - DNA, 20 bp, Artificial Sequence
  sgRNA
  NTC_990
tcatagcttacgacgtcgct

SEQ ID NO: 65738 - DNA, 20 bp, Artificial Sequence
  sgRNA
  NTC_991
tgtacgtactacgcgcagcg

SEQ ID NO: 65739 - DNA, 20 bp, Artificial Sequence
  sgRNA
  NTC_992
acattggcgacacgagacga

SEQ ID NO: 65740 - DNA, 20 bp, Artificial Sequence
  sgRNA
  NTC_993
cgctcgggacggaaacatcg

SEQ ID NO: 65741 - DNA, 20 bp, Artificial Sequence
  sgRNA
  NTC_994
tcgcgcttgatacgcattca

SEQ ID NO: 65742 - DNA, 20 bp, Artificial Sequence
  sgRNA
  NTC_995
gaataactctcgcacgaccg

SEQ ID NO: 65743 - DNA, 20 bp, Artificial Sequence
  sgRNA
  NTC_996
gttgttggatcgcgataccg

SEQ ID NO: 65744 - DNA, 20 bp, Artificial Sequence
  sgRNA
  NTC_997
gcggtatcgcagttcgctta

SEQ ID NO: 65745 - DNA, 20 bp, Artificial Sequence
  sgRNA
  NTC_998
gattcgacgaaactcgactt

SEQ ID NO: 65746 - DNA, 20 bp, Artificial Sequence
  sgRNA
  NTC_999
acggtgcgaggatgcgtcgc

SEQ ID NO: 65747 - DNA, 20 bp, Artificial Sequence
  sgRNA
  NTC_1000
tagctataggctcgcgtgaa

SEQ ID NO: 65748 - DNA, 20 bp, Artificial Sequence
  sgRNA
  NTC_1001
cgttcaactagactcgcccc

SEQ ID NO: 65749 - DNA, 20 bp, Artificial Sequence
  sgRNA
  NTC_1002
ttgcagctcgatcacgaatg

SEQ ID NO: 65750 - DNA, 20 bp, Artificial Sequence
  sgRNA
  NTC_1003
cgtcgcaggtcgttaacgat

SEQ ID NO: 65751 - DNA, 20 bp, Artificial Sequence
  sgRNA
  NTC_1004
cgaactggggcttcgatacg

SEQ ID NO: 65752 - DNA, 20 bp, Artificial Sequence
  sgRNA
  NTC_1005
agaacgtgtctgcccgcgtt

SEQ ID NO: 65753 - DNA, 20 bp, Artificial Sequence
  sgRNA
  NTC_1006
atttaatttcgcgcgcactt

SEQ ID NO: 65754 - DNA, 20 bp, Artificial Sequence
  sgRNA
  NTC_1007
ctcgaggcgtgtagcccgtc

SEQ ID NO: 65755 - DNA, 20 bp, Artificial Sequence
  sgRNA
  NTC_1008
gcgattgcatgatcgtaacg

SEQ ID NO: 65756 - DNA, 20 bp, Artificial Sequence
  sgRNA
  NTC_1009
aagcaatcgggcgtatcgca

SEQ ID NO: 65757 - DNA, 20 bp, Artificial Sequence
  sgRNA
  NTC_1010
tatgcgggcatcgcgtctat

SEQ ID NO: 65758 - DNA, 20 bp, Artificial Sequence
  sgRNA
  NTC_1011
caacttcgtacgcgctacct

SEQ ID NO: 65759 - DNA, 20 bp, Artificial Sequence
  sgRNA
  NTC_1012
gaagttgggctcgccgaata

SEQ ID NO: 65760 - DNA, 20 bp, Artificial Sequence
  sgRNA
  NTC_1013
cgtacgagtggtagtgcgcc

SEQ ID NO: 65761 - DNA, 20 bp, Artificial Sequence
  sgRNA
  NTC_1014
aggttattacgcgtcagccg

SEQ ID NO: 65762 - DNA, 20 bp, Artificial Sequence
  sgRNA
  NTC_1015
gtctaatcgttgcgccgaag

SEQ ID NO: 65763 - DNA, 20 bp, Artificial Sequence
  sgRNA
  NTC_1016
aagcgtcaaataatcgttga

SEQ ID NO: 65764 - DNA, 20 bp, Artificial Sequence
  sgRNA
  NTC_1017
atgtggtcgacttacaccgc

SEQ ID NO: 65765 - DNA, 20 bp, Artificial Sequence
  sgRNA
  NTC_1018
catcgtagtcgtcgtaatac

SEQ ID NO: 65766 - DNA, 20 bp, Artificial Sequence
  sgRNA
  NTC_1019
cgcgacggattgtgaccgct

SEQ ID NO: 65767 - DNA, 20 bp, Artificial Sequence
  sgRNA
  NTC_1020
tcggcacgattaccactcgc

SEQ ID NO: 65768 - DNA, 20 bp, Artificial Sequence
  sgRNA
  NTC_1021
ggactctcgactcgcgaatt

SEQ ID NO: 65769 - DNA, 20 bp, Artificial Sequence
  sgRNA
  NTC_1022
tgggtgtcactacgcaagtt

SEQ ID NO: 65770 - DNA, 20 bp, Artificial Sequence
  sgRNA
  NTC_1023
tcgactaacggcgtcctccg

SEQ ID NO: 65771 - DNA, 20 bp, Artificial Sequence
  sgRNA
  NTC_1024
gaaatcggttgtcgacgtcg

SEQ ID NO: 65772 - DNA, 20 bp, Artificial Sequence
  sgRNA
  NTC_1025
agtcgacaattgttgcgacg

SEQ ID NO: 65773 - DNA, 20 bp, Artificial Sequence
  sgRNA
  NTC_1026
ttaagatattcgcgtaaccg

SEQ ID NO: 65774 - DNA, 20 bp, Artificial Sequence
  sgRNA
  NTC_1027
cgaagtagattacccgcgct

SEQ ID NO: 65775 - DNA, 20 bp, Artificial Sequence
  sgRNA
  NTC_1028
ttgctcgatcgtcgcacccg

SEQ ID NO: 65776 - DNA, 20 bp, Artificial Sequence
  sgRNA
  NTC_1029
gcacatcgctacacgacgat

SEQ ID NO: 65777 - DNA, 20 bp, Artificial Sequence
  sgRNA
  NTC_1030
ggcgagcaattcctctcaac

SEQ ID NO: 65778 - DNA, 20 bp, Artificial Sequence
  sgRNA
  NTC_1031
cgcgatgtacggctccatat

SEQ ID NO: 65779 - DNA, 20 bp, Artificial Sequence
  sgRNA
  NTC_1032
acgacgagcgaccgtgcata

SEQ ID NO: 65780 - DNA, 20 bp, Artificial Sequence
  sgRNA
  NTC_1033
tagcgtggatatttcgttcg

SEQ ID NO: 65781 - DNA, 20 bp, Artificial Sequence
  sgRNA
  NTC_1034
tatcatgcagtcgcgactgt

SEQ ID NO: 65782 - DNA, 20 bp, Artificial Sequence
  sgRNA
  NTC_1035
caagcacgactacccgataa

SEQ ID NO: 65783 - DNA, 20 bp, Artificial Sequence
  sgRNA
  NTC_1036
ggagctcacgtacgacccgt

SEQ ID NO: 65784 - DNA, 20 bp, Artificial Sequence
  sgRNA
  NTC_1037
cgaggcgggtaacaaccgat

SEQ ID NO: 65785 - DNA, 20 bp, Artificial Sequence
  sgRNA
  NTC_1038
ggcggaaatcgccccctata

SEQ ID NO: 65786 - DNA, 20 bp, Artificial Sequence
  sgRNA
  NTC_1039
tcgaatcacgaaagtgcgac

SEQ ID NO: 65787 - DNA, 20 bp, Artificial Sequence
  sgRNA
  NTC_1040
atgtggcggcaatcgatgcg

SEQ ID NO: 65788 - DNA, 20 bp, Artificial Sequence
  sgRNA
  NTC_1041
acaatcgcgaatcacgcgcg

SEQ ID NO: 65789 - DNA, 20 bp, Artificial Sequence
  sgRNA
  NTC_1042
gtatagggcgtcaccgcacg

SEQ ID NO: 65790 - DNA, 20 bp, Artificial Sequence
  sgRNA
  NTC_1043
ctcgttacgatgcgcgttta

SEQ ID NO: 65791 - DNA, 20 bp, Artificial Sequence
  sgRNA
  NTC_1044
cgcggaaatcgcgcgctctt

SEQ ID NO: 65792 - DNA, 20 bp, Artificial Sequence
  sgRNA
  NTC_1045
cacgaggcatatccgaaatg

SEQ ID NO: 65793 - DNA, 20 bp, Artificial Sequence
  sgRNA
  NTC_1046
tcgatttcggcgcacctgct

SEQ ID NO: 65794 - DNA, 20 bp, Artificial Sequence
  sgRNA
  NTC_1047
tattaggttcaccgcgcaag

SEQ ID NO: 65795 - DNA, 20 bp, Artificial Sequence
  sgRNA
  NTC_1048
tcgtaggcggcgtgcgcctc

SEQ ID NO: 65796 - DNA, 20 bp, Artificial Sequence
  sgRNA
  NTC_1049
agtgcgagtatcactacgaa

SEQ ID NO: 65797 - DNA, 20 bp, Artificial Sequence
  sgRNA
  NTC_1050
gtaaacggggcgaccgatct

SEQ ID NO: 65798 - DNA, 20 bp, Artificial Sequence
  sgRNA
  NTC_1051
gataggcgcgatctcgccgt

SEQ ID NO: 65799 - DNA, 20 bp, Artificial Sequence
  sgRNA
  NTC_1052
tgtcgcactcgcgcagacat

SEQ ID NO: 65800 - DNA, 20 bp, Artificial Sequence
  sgRNA
  NTC_1053
gcgttacatgaaccgacgac

SEQ ID NO: 65801 - DNA, 20 bp, Artificial Sequence
  sgRNA
  NTC_1054
atgtatcaatgcacccgtcg

SEQ ID NO: 65802 - DNA, 20 bp, Artificial Sequence
  sgRNA
  NTC_1055
tttgcgacgcacgactagcg

SEQ ID NO: 65803 - DNA, 20 bp, Artificial Sequence
  sgRNA
  NTC_1056
caagggcgctcgatgccatc

SEQ ID NO: 65804 - DNA, 20 bp, Artificial Sequence
  sgRNA
  NTC_1057
agcttgtcgcgtctcgaaac

SEQ ID NO: 65805 - DNA, 20 bp, Artificial Sequence
  sgRNA
  NTC_1058
gcgtaagactctctcgatcc

SEQ ID NO: 65806 - DNA, 20 bp, Artificial Sequence
  sgRNA
  NTC_1059
gcaataacatgacacgccac

SEQ ID NO: 65807 - DNA, 20 bp, Artificial Sequence
  sgRNA
  NTC_1060
ataatcactagccgcgagta

SEQ ID NO: 65808 - DNA, 20 bp, Artificial Sequence
  sgRNA
  NTC_1061
ggcgggatcttacgatgcgt

SEQ ID NO: 65809 - DNA, 20 bp, Artificial Sequence
  sgRNA
  NTC_1062
gtataggcttcgtgcgctac

SEQ ID NO: 65810 - DNA, 20 bp, Artificial Sequence
  sgRNA
  NTC_1063
gcgaagcgcttgcgcgcaat

SEQ ID NO: 65811 - DNA, 20 bp, Artificial Sequence
  sgRNA
  NTC_1064
ttaggacacaatctcgtacg

SEQ ID NO: 65812 - DNA, 20 bp, Artificial Sequence
  sgRNA
  NTC_1065
tgcactaacgcgattacatc

SEQ ID NO: 65813 - DNA, 20 bp, Artificial Sequence
  sgRNA
  NTC_1066
gcgtatctcgcgaccttcgt

SEQ ID NO: 65814 - DNA, 20 bp, Artificial Sequence
  sgRNA
  NTC_1067
ggggcaaaacgtgccgcatg

SEQ ID NO: 65815 - DNA, 20 bp, Artificial Sequence
  sgRNA
  NTC_1068
gagactggcttagtcgaacg

SEQ ID NO: 65816 - DNA, 20 bp, Artificial Sequence
  sgRNA
  NTC_1069
gtcgtctaggcgacctttca

SEQ ID NO: 65817 - DNA, 20 bp, Artificial Sequence
  sgRNA
  NTC_1070
aagagtacacgacgcgtcaa

SEQ ID NO: 65818 - DNA, 20 bp, Artificial Sequence
  sgRNA
  NTC_1071
tgagtacgcgatttcacgac

SEQ ID NO: 65819 - DNA, 20 bp, Artificial Sequence
  sgRNA
  NTC_1072
gagtcgcgcgcgtgattgat

SEQ ID NO: 65820 - DNA, 20 bp, Artificial Sequence
  sgRNA
  NTC_1073
cgttggatcggcgtcaatcc

SEQ ID NO: 65821 - DNA, 20 bp, Artificial Sequence
  sgRNA
  NTC_1074
cttacgcgagatgcgaaaac

SEQ ID NO: 65822 - DNA, 20 bp, Artificial Sequence
  sgRNA
  NTC_1075
acgcggcttgagcgagtatg

SEQ ID NO: 65823 - DNA, 20 bp, Artificial Sequence
  sgRNA
  NTC_1076
ctatgggagcgatccgaaca

SEQ ID NO: 65824 - DNA, 20 bp, Artificial Sequence
  sgRNA
  NTC_1077
gtatttgatggcacctacgc

SEQ ID NO: 65825 - DNA, 20 bp, Artificial Sequence
  sgRNA
  NTC_1078
gtgcaaacggcgtcaacttc

SEQ ID NO: 65826 - DNA, 20 bp, Artificial Sequence
  sgRNA
  NTC_1079
gcggacaattcgcagacgat

SEQ ID NO: 65827 - DNA, 20 bp, Artificial Sequence
  sgRNA
  NTC_1080
cacgcagggctagtccgttc

SEQ ID NO: 65828 - DNA, 20 bp, Artificial Sequence
  sgRNA
  NTC_1081
ttcatagcgtcgatacacga

SEQ ID NO: 65829 - DNA, 20 bp, Artificial Sequence
  sgRNA
  NTC_1082
tcataaacttcacgcgtagt

SEQ ID NO: 65830 - DNA, 20 bp, Artificial Sequence
  sgRNA
  NTC_1083
cgtcggtattagtaagcgac

SEQ ID NO: 65831 - DNA, 20 bp, Artificial Sequence
  sgRNA
  NTC_1084
ggacggcgtaatttccgcta

SEQ ID NO: 65832 - DNA, 20 bp, Artificial Sequence
  sgRNA
  NTC_1085
cgacgaatgcgcttacgtta

SEQ ID NO: 65833 - DNA, 20 bp, Artificial Sequence
  sgRNA
  NTC_1086
tttaaaaggcgcgactaatc

SEQ ID NO: 65834 - DNA, 20 bp, Artificial Sequence
  sgRNA
  NTC_1087
agtctaagcgcgacgtcatc

SEQ ID NO: 65835 - DNA, 20 bp, Artificial Sequence
  sgRNA
  NTC_1088
gctgcgaattataacgcgag

SEQ ID NO: 65836 - DNA, 20 bp, Artificial Sequence
  sgRNA
  NTC_1089
aggtgtatatattcgcgacc

SEQ ID NO: 65837 - DNA, 20 bp, Artificial Sequence
  sgRNA
  NTC_1090
gaaacacgaacgtcgcgttc

SEQ ID NO: 65838 - DNA, 20 bp, Artificial Sequence
  sgRNA
  NTC_1091
tcgtacaaatcgataattgc

SEQ ID NO: 65839 - DNA, 20 bp, Artificial Sequence
  sgRNA
  NTC_1092
tgcattcggcggaatcgtac

SEQ ID NO: 65840 - DNA, 20 bp, Artificial Sequence
  sgRNA
  NTC_1093
taaactgtgactcgacgtcg

SEQ ID NO: 65841 - DNA, 20 bp, Artificial Sequence
  sgRNA
  NTC_1094
tgtggtcaggcgtgcgccaa

SEQ ID NO: 65842 - DNA, 20 bp, Artificial Sequence
  sgRNA
  NTC_1095
aggttagttcggcgtgctac

SEQ ID NO: 65843 - DNA, 20 bp, Artificial Sequence
  sgRNA
  NTC_1096
aaacggcgctaacgcgatgt

SEQ ID NO: 65844 - DNA, 20 bp, Artificial Sequence
  sgRNA
  NTC_1097
gcgaactagtcgtacgcctg

SEQ ID NO: 65845 - DNA, 20 bp, Artificial Sequence
  sgRNA
  NTC_1098
aagtcgcgttcgcatcatca

SEQ ID NO: 65846 - DNA, 20 bp, Artificial Sequence
  sgRNA
  NTC_1099
cggatgagtcgattcgtcga

SEQ ID NO: 65847 - DNA, 20 bp, Artificial Sequence
  sgRNA
  NTC_1100
gacgggtaactcgtaccgat

SEQ ID NO: 65848 - DNA, 20 bp, Artificial Sequence
  sgRNA
  NTC_1101
cgagtttggcacgttcgata

SEQ ID NO: 65849 - DNA, 20 bp, Artificial Sequence
  sgRNA
  NTC_1102
cgtgtaaggagtgcgatagt

SEQ ID NO: 65850 - DNA, 20 bp, Artificial Sequence
  sgRNA
  NTC_1103
cggactcgtttcacgcaact

SEQ ID NO: 65851 - DNA, 20 bp, Artificial Sequence
  sgRNA
  NTC_1104
gataattagggccgcgtcga

SEQ ID NO: 65852 - DNA, 20 bp, Artificial Sequence
  sgRNA
  NTC_1105
agtgctcgtgcgccgatacg

SEQ ID NO: 65853 - DNA, 20 bp, Artificial Sequence
  sgRNA
  NTC_1106
tttctacgggcactaacgcg

SEQ ID NO: 65854 - DNA, 20 bp, Artificial Sequence
  sgRNA
  NTC_1107
tcgagagcgtaccgccctat

SEQ ID NO: 65855 - DNA, 20 bp, Artificial Sequence
  sgRNA
  NTC_1108
gttgcttgagacgcgatcga

SEQ ID NO: 65856 - DNA, 20 bp, Artificial Sequence
  sgRNA
  NTC_1109
caacgcgcggttgattgtgc

SEQ ID NO: 65857 - DNA, 20 bp, Artificial Sequence
  sgRNA
  NTC_1110
ggcggaattcgtcgtcgaaa

SEQ ID NO: 65858 - DNA, 20 bp, Artificial Sequence
  sgRNA
  NTC_1111
ggagcggtgctaatcgccat

SEQ ID NO: 65859 - DNA, 20 bp, Artificial Sequence
  sgRNA
  NTC_1112
tagtggcgtacatcgctcga

SEQ ID NO: 65860 - DNA, 20 bp, Artificial Sequence
  sgRNA
  NTC_1113
cggtcacgagcgcgcaatcg

SEQ ID NO: 65861 - DNA, 20 bp, Artificial Sequence
  sgRNA
  NTC_1114
ctgaatcgatgccgcatcga

SEQ ID NO: 65862 - DNA, 20 bp, Artificial Sequence
  sgRNA
  NTC_1115
tggtcgcgtcgatcaatttg

SEQ ID NO: 65863 - DNA, 20 bp, Artificial Sequence
  sgRNA
  NTC_1116
gttactgcgcacaacgcctt

SEQ ID NO: 65864 - DNA, 20 bp, Artificial Sequence
  sgRNA
  NTC_1117
ttacggtaggtcacgcccta

SEQ ID NO: 65865 - DNA, 20 bp, Artificial Sequence
  sgRNA
  NTC_1118
gtacgtaaactctttacgtc

SEQ ID NO: 65866 - DNA, 20 bp, Artificial Sequence
  sgRNA
  NTC_1119
cgtgacgtcggcccgaatgc

SEQ ID NO: 65867 - DNA, 20 bp, Artificial Sequence
  sgRNA
  NTC_1120
ttaatgatgggcgctacgag

SEQ ID NO: 65868 - DNA, 20 bp, Artificial Sequence
  sgRNA
  NTC_1121
gtgctattcgcgtagcgaag

SEQ ID NO: 65869 - DNA, 20 bp, Artificial Sequence
  sgRNA
  NTC_1122
ctagcgacgctaatcgctgt

SEQ ID NO: 65870 - DNA, 20 bp, Artificial Sequence
  sgRNA
  NTC_1123
ctgttatcaacgtcgcgata

SEQ ID NO: 65871 - DNA, 20 bp, Artificial Sequence
  sgRNA
  NTC_1124
ttgcgaaggaacccgcttat

SEQ ID NO: 65872 - DNA, 20 bp, Artificial Sequence
  sgRNA
  NTC_1125
cattatagggatcgctaaac

SEQ ID NO: 65873 - DNA, 20 bp, Artificial Sequence
  sgRNA
  NTC_1126
tctcgcgcggtcgaaagccg

SEQ ID NO: 65874 - DNA, 20 bp, Artificial Sequence
  sgRNA
  NTC_1127
cgttaatacttatcgtcgca

SEQ ID NO: 65875 - DNA, 20 bp, Artificial Sequence
  sgRNA
  NTC_1128
gggtgcgagagcgatcagta

SEQ ID NO: 65876 - DNA, 20 bp, Artificial Sequence
  sgRNA
  NTC_1129
gagtaactactcaccgtacg

SEQ ID NO: 65877 - DNA, 20 bp, Artificial Sequence
  sgRNA
  NTC_1130
tcgcatcgtacgcgctagat

SEQ ID NO: 65878 - DNA, 20 bp, Artificial Sequence
  sgRNA
  NTC_1131
ttcgtgacgtggttcttcga

SEQ ID NO: 65879 - DNA, 20 bp, Artificial Sequence
  sgRNA
  NTC_1132
taagtcggtatgttcgcctc

SEQ ID NO: 65880 - DNA, 20 bp, Artificial Sequence
  sgRNA
  NTC_1133
cacggtggcatactcgtcgt

SEQ ID NO: 65881 - DNA, 20 bp, Artificial Sequence
  sgRNA
  NTC_1134
ttggtacattagagcgcgac

SEQ ID NO: 65882 - DNA, 20 bp, Artificial Sequence
  sgRNA
  NTC_1135
ggatgtcgaacgtaccctga

SEQ ID NO: 65883 - DNA, 20 bp, Artificial Sequence
  sgRNA
  NTC_1136
attacgctgtggcacgatag

SEQ ID NO: 65884 - DNA, 20 bp, Artificial Sequence
  sgRNA
  NTC_1137
tcaatcgcgtctgatagtac

SEQ ID NO: 65885 - DNA, 20 bp, Artificial Sequence
  sgRNA
  NTC_1138
gtcgagctgataaccatcgt

SEQ ID NO: 65886 - DNA, 20 bp, Artificial Sequence
  sgRNA
  NTC_1139
aagatggcggcgaaacgttc

SEQ ID NO: 65887 - DNA, 20 bp, Artificial Sequence
  sgRNA
  NTC_1140
aacgcgtgatgatcgtctat

SEQ ID NO: 65888 - DNA, 20 bp, Artificial Sequence
  sgRNA
  NTC_1141
cgacgcatcgagttctacgt

SEQ ID NO: 65889 - DNA, 20 bp, Artificial Sequence
  sgRNA
  NTC_1142
acgttacgcgttgcgctgca

SEQ ID NO: 65890 - DNA, 20 bp, Artificial Sequence
  sgRNA
  NTC_1143
ggacgagttgcgccgatgtt

SEQ ID NO: 65891 - DNA, 20 bp, Artificial Sequence
  sgRNA
  NTC_1144
gtcggactggcgccgcatac

SEQ ID NO: 65892 - DNA, 20 bp, Artificial Sequence
  sgRNA
  NTC_1145
tgtgcggcgtgcaccaaacg

SEQ ID NO: 65893 - DNA, 20 bp, Artificial Sequence
  sgRNA
  NTC_1146
ggactctattcgtacgataa

SEQ ID NO: 65894 - DNA, 20 bp, Artificial Sequence
  sgRNA
  NTC_1147
gaattggcgtcgtgcgctga

SEQ ID NO: 65895 - DNA, 20 bp, Artificial Sequence
  sgRNA
  NTC_1148
tatgtgacgattactacccg

SEQ ID NO: 65896 - DNA, 20 bp, Artificial Sequence
  sgRNA
  NTC_1149
attgtcgggcgaagccgtac

SEQ ID NO: 65897 - DNA, 20 bp, Artificial Sequence
  sgRNA
  NTC_1150
gcatcggacgcgcgacaagc

SEQ ID NO: 65898 - DNA, 20 bp, Artificial Sequence
  sgRNA
  NTC_1151
cgtagaggcacacgacgacg

SEQ ID NO: 65899 - DNA, 20 bp, Artificial Sequence
  sgRNA
  NTC_1152
tatatcgcgcgtaaccccac

SEQ ID NO: 65900 - DNA, 20 bp, Artificial Sequence
  sgRNA
  NTC_1153
caatgagcgactgccgattg

SEQ ID NO: 65901 - DNA, 20 bp, Artificial Sequence
  sgRNA
  NTC_1154
ggtcgttattaacgttagat

SEQ ID NO: 65902 - DNA, 20 bp, Artificial Sequence
  sgRNA
  NTC_1155
gacagcgaatctcgcgacat

SEQ ID NO: 65903 - DNA, 20 bp, Artificial Sequence
  sgRNA
  NTC_1156
aagtggtgcgatatcgttcc

SEQ ID NO: 65904 - DNA, 20 bp, Artificial Sequence
  sgRNA
  NTC_1157
gtgcaaacggcatagcgtcg

SEQ ID NO: 65905 - DNA, 20 bp, Artificial Sequence
  sgRNA
  NTC_1158
gctcgacgatacacatcgac

SEQ ID NO: 65906 - DNA, 20 bp, Artificial Sequence
  sgRNA
  NTC_1159
ggtagaggatacgcgcagcc

SEQ ID NO: 65907 - DNA, 20 bp, Artificial Sequence
  sgRNA
  NTC_1160
tatggagcgtactgcatcga

SEQ ID NO: 65908 - DNA, 20 bp, Artificial Sequence
  sgRNA
  NTC_1161
ggttcgcgattgcgcgtcct

SEQ ID NO: 65909 - DNA, 20 bp, Artificial Sequence
  sgRNA
  NTC_1162
ttcggcagatacgtccgact

SEQ ID NO: 65910 - DNA, 20 bp, Artificial Sequence
  sgRNA
  NTC_1163
gcgcgtgatatctcgaagac

SEQ ID NO: 65911 - DNA, 20 bp, Artificial Sequence
  sgRNA
  NTC_1164
tcacgacgcttgcatccgac

SEQ ID NO: 65912 - DNA, 20 bp, Artificial Sequence
  sgRNA
  NTC_1165
gggtttcttgctcgcgctac

SEQ ID NO: 65913 - DNA, 20 bp, Artificial Sequence
  sgRNA
  NTC_1166
atgttgcggatacgatgcgc

SEQ ID NO: 65914 - DNA, 20 bp, Artificial Sequence
  sgRNA
  NTC_1167
gcaacaatttgacgcgatcg

SEQ ID NO: 65915 - DNA, 20 bp, Artificial Sequence
  sgRNA
  NTC_1168
ttggtacgcacgatgttgcg

SEQ ID NO: 65916 - DNA, 20 bp, Artificial Sequence
  sgRNA
  NTC_1169
cagtttcgacgagacgctct

SEQ ID NO: 65917 - DNA, 20 bp, Artificial Sequence
  sgRNA
  NTC_1170
gtcgatgcgcacgccaaaca

SEQ ID NO: 65918 - DNA, 20 bp, Artificial Sequence
  sgRNA
  NTC_1171
gttacggaaagacgcgctgt

SEQ ID NO: 65919 - DNA, 20 bp, Artificial Sequence
  sgRNA
  NTC_1172
ggtaagcgaataacgctacc

SEQ ID NO: 65920 - DNA, 20 bp, Artificial Sequence
  sgRNA
  NTC_1173
gtcgatagcatatcgaagag

SEQ ID NO: 65921 - DNA, 20 bp, Artificial Sequence
  sgRNA
  NTC_1174
ggtcgttaaattcgctcgta

SEQ ID NO: 65922 - DNA, 20 bp, Artificial Sequence
  sgRNA
  NTC_1175
gtatcattaagtgcgacgtt

SEQ ID NO: 65923 - DNA, 20 bp, Artificial Sequence
  sgRNA
  NTC_1176
attacgatagttcgacgtct

SEQ ID NO: 65924 - DNA, 20 bp, Artificial Sequence
  sgRNA
  NTC_1177
cggcggtgtatacgcgtccg

SEQ ID NO: 65925 - DNA, 20 bp, Artificial Sequence
  sgRNA
  NTC_1178
gcttatattcaacgatcatc

SEQ ID NO: 65926 - DNA, 20 bp, Artificial Sequence
  sgRNA
  NTC_1179
cgtcgaaactacctatcgcg

SEQ ID NO: 65927 - DNA, 20 bp, Artificial Sequence
  sgRNA
  NTC_1180
ttactacgcgcaaccgctct

SEQ ID NO: 65928 - DNA, 20 bp, Artificial Sequence
  sgRNA
  NTC_1181
tgtcgacgtggcgtcgaatt

SEQ ID NO: 65929 - DNA, 20 bp, Artificial Sequence
  sgRNA
  NTC_1182
tggtctacgtacgtcgtgat

SEQ ID NO: 65930 - DNA, 20 bp, Artificial Sequence
  sgRNA
  NTC_1183
gataagggataatgcgatcc

SEQ ID NO: 65931 - DNA, 20 bp, Artificial Sequence
  sgRNA
  NTC_1184
ttacgcatcttgatcgtcat

SEQ ID NO: 65932 - DNA, 20 bp, Artificial Sequence
  sgRNA
  NTC_1185
gaatacgatcgatctactcg

SEQ ID NO: 65933 - DNA, 20 bp, Artificial Sequence
  sgRNA
  NTC_1186
acgctgtaacgatcccgtgc

SEQ ID NO: 65934 - DNA, 20 bp, Artificial Sequence
  sgRNA
  NTC_1187
tgaatcgacggttcgcgata

SEQ ID NO: 65935 - DNA, 20 bp, Artificial Sequence
  sgRNA
  NTC_1188
gctatagtgcaatccgtcgc

SEQ ID NO: 65936 - DNA, 20 bp, Artificial Sequence
  sgRNA
  NTC_1189
acaggagtaacgtacgagtc

SEQ ID NO: 65937 - DNA, 20 bp, Artificial Sequence
  sgRNA
  NTC_1190
gagacgacaacttgcgatcg

SEQ ID NO: 65938 - DNA, 20 bp, Artificial Sequence
  sgRNA
  NTC_1191
cggagttgtcgacgttcacg

SEQ ID NO: 65939 - DNA, 20 bp, Artificial Sequence
  sgRNA
  NTC_1192
gtgggcggtatcgatccgac

SEQ ID NO: 65940 - DNA, 20 bp, Artificial Sequence
  sgRNA
  NTC_1193
atagggatcgtgctcgacca

SEQ ID NO: 65941 - DNA, 20 bp, Artificial Sequence
  sgRNA
  NTC_1194
tggagcagtctcccgaaact

SEQ ID NO: 65942 - DNA, 20 bp, Artificial Sequence
  sgRNA
  NTC_1195
ggcggtatatcgtgctaacg

SEQ ID NO: 65943 - DNA, 20 bp, Artificial Sequence
  sgRNA
  NTC_1196
tacttacaggcgcccgttac

SEQ ID NO: 65944 - DNA, 20 bp, Artificial Sequence
  sgRNA
  NTC_1197
acggagtcgatcccgcatta

SEQ ID NO: 65945 - DNA, 20 bp, Artificial Sequence
  sgRNA
  NTC_1198
gatttaagcggtcgccgcta

SEQ ID NO: 65946 - DNA, 20 bp, Artificial Sequence
  sgRNA
  NTC_1199
tcgtgcgctacgccactttg

SEQ ID NO: 65947 - DNA, 20 bp, Artificial Sequence
  sgRNA
  NTC_1200
gggtcacgatggctcgtcaa

SEQ ID NO: 65948 - DNA, 20 bp, Artificial Sequence
  sgRNA
  NTC_1201
ctaggatcataccgacccat

SEQ ID NO: 65949 - DNA, 20 bp, Artificial Sequence
  sgRNA
  NTC_1202
cgctgtaggcgtcctacgcg

SEQ ID NO: 65950 - DNA, 20 bp, Artificial Sequence
  sgRNA
  NTC_1203
gcgtactgcataccgatccg

SEQ ID NO: 65951 - DNA, 20 bp, Artificial Sequence
  sgRNA
  NTC_1204
agtcgcatggtcgacgcgta

SEQ ID NO: 65952 - DNA, 20 bp, Artificial Sequence
  sgRNA
  NTC_1205
cggtttatgcgacgtcctac

SEQ ID NO: 65953 - DNA, 20 bp, Artificial Sequence
  sgRNA
  NTC_1206
ctcagttatgagcgcgctgt

SEQ ID NO: 65954 - DNA, 20 bp, Artificial Sequence
  sgRNA
  NTC_1207
aagattgacgcgcgcttagt

SEQ ID NO: 65955 - DNA, 20 bp, Artificial Sequence
  sgRNA
  NTC_1208
gtgtatatgttcccgcgttc

SEQ ID NO: 65956 - DNA, 20 bp, Artificial Sequence
  sgRNA
  NTC_1209
tctaacgctcgtcgcccgca

SEQ ID NO: 65957 - DNA, 20 bp, Artificial Sequence
  sgRNA
  NTC_1210
ttcggttacgcgcttaaccg

SEQ ID NO: 65958 - DNA, 20 bp, Artificial Sequence
  sgRNA
  NTC_1211
gcgcgaaactagaccttatt

SEQ ID NO: 65959 - DNA, 20 bp, Artificial Sequence
  sgRNA
  NTC_1212
tgtatcgtatagcgcgccac

SEQ ID NO: 65960 - DNA, 20 bp, Artificial Sequence
  sgRNA
  NTC_1213
tcgactcgcaagcgtagttt

SEQ ID NO: 65961 - DNA, 20 bp, Artificial Sequence
  sgRNA
  NTC_1214
tcatactgcgaaaaccgtcg

SEQ ID NO: 65962 - DNA, 20 bp, Artificial Sequence
  sgRNA
  NTC_1215
ttacggataatgcgtcgcat

SEQ ID NO: 65963 - DNA, 20 bp, Artificial Sequence
  sgRNA
  NTC_1216
tgatgtcgggtccgcgcata

SEQ ID NO: 65964 - DNA, 20 bp, Artificial Sequence
  sgRNA
  NTC_1217
gatatgaggcgcgcgctttc

SEQ ID NO: 65965 - DNA, 20 bp, Artificial Sequence
  sgRNA
  NTC_1218
gatgggcaatctaccgagcg

SEQ ID NO: 65966 - DNA, 20 bp, Artificial Sequence
  sgRNA
  NTC_1219
agcgcgcaatggcgcccgat

SEQ ID NO: 65967 - DNA, 20 bp, Artificial Sequence
  sgRNA
  NTC_1220
gtacggtaataagcgcctga

SEQ ID NO: 65968 - DNA, 20 bp, Artificial Sequence
  sgRNA
  NTC_1221
tagcgcgcgctacgagcatt

SEQ ID NO: 65969 - DNA, 20 bp, Artificial Sequence
  sgRNA
  NTC_1222
tgtgcgtcggtgcgccgtcc

SEQ ID NO: 65970 - DNA, 20 bp, Artificial Sequence
  sgRNA
  NTC_1223
tacgcatgattcatcgacac

SEQ ID NO: 65971 - DNA, 20 bp, Artificial Sequence
  sgRNA
  NTC_1224
aacgtgcgcagcgcgcacta

SEQ ID NO: 65972 - DNA, 20 bp, Artificial Sequence
  sgRNA
  NTC_1225
agctcgggtacgacgatacg

SEQ ID NO: 65973 - DNA, 20 bp, Artificial Sequence
  sgRNA
  NTC_1226
gcgtgagctacgaccgcaag

SEQ ID NO: 65974 - DNA, 20 bp, Artificial Sequence
  sgRNA
  NTC_1227
tatgacgcgaaagcgcgttc

SEQ ID NO: 65975 - DNA, 20 bp, Artificial Sequence
  sgRNA
  NTC_1228
agtcggtaatacgatcgtaa

SEQ ID NO: 65976 - DNA, 20 bp, Artificial Sequence
  sgRNA
  NTC_1229
caatctaggttatgcgacca

SEQ ID NO: 65977 - DNA, 20 bp, Artificial Sequence
  sgRNA
  NTC_1230
ttatcgcttggtgatccgcc

SEQ ID NO: 65978 - DNA, 20 bp, Artificial Sequence
  sgRNA
  NTC_1231
aggacgattgctacccgcgt

SEQ ID NO: 65979 - DNA, 20 bp, Artificial Sequence
  sgRNA
  NTC_1232
agcgtatcgtagcgagcaaa

SEQ ID NO: 65980 - DNA, 20 bp, Artificial Sequence
  sgRNA
  NTC_1233
gacgtatgatcgcttacgat

SEQ ID NO: 65981 - DNA, 20 bp, Artificial Sequence
  sgRNA
  NTC_1234
gacaggctatcgcgctccat

SEQ ID NO: 65982 - DNA, 20 bp, Artificial Sequence
  sgRNA
  NTC_1235
cactcgaagtgaatcgataa

SEQ ID NO: 65983 - DNA, 20 bp, Artificial Sequence
  sgRNA
  NTC_1236
acgaaggcgggaccacgtat

SEQ ID NO: 65984 - DNA, 20 bp, Artificial Sequence
  sgRNA
  NTC_1237
aggtttcactacctgcgacg

SEQ ID NO: 65985 - DNA, 20 bp, Artificial Sequence
  sgRNA
  NTC_1238
atgcgctcgcgtgccgaacc

SEQ ID NO: 65986 - DNA, 20 bp, Artificial Sequence
  sgRNA
  NTC_1239
tgcggtcgaatctacgtcta

SEQ ID NO: 65987 - DNA, 20 bp, Artificial Sequence
  sgRNA
  NTC_1240
gtatagtcgtcgaagatctc

SEQ ID NO: 65988 - DNA, 20 bp, Artificial Sequence
  sgRNA
  NTC_1241
ggggtcgggcgtatcataac

SEQ ID NO: 65989 - DNA, 20 bp, Artificial Sequence
  sgRNA
  NTC_1242
acgttcatactacaccgata

SEQ ID NO: 65990 - DNA, 20 bp, Artificial Sequence
  sgRNA
  NTC_1243
agctcattagcgcgaaacca

SEQ ID NO: 65991 - DNA, 20 bp, Artificial Sequence
  sgRNA
  NTC_1244
cgcggtcggatatcgtatgc

SEQ ID NO: 65992 - DNA, 20 bp, Artificial Sequence
  sgRNA
  NTC_1245
gctatgtaacaacgcgtaac

SEQ ID NO: 65993 - DNA, 20 bp, Artificial Sequence
  sgRNA
  NTC_1246
ttgcgcgcgatcgttgtgac

SEQ ID NO: 65994 - DNA, 20 bp, Artificial Sequence
  sgRNA
  NTC_1247
gagtacaattcgcgaccccg

SEQ ID NO: 65995 - DNA, 20 bp, Artificial Sequence
  sgRNA
  NTC_1248
acgtagggtctacgcgtatt

SEQ ID NO: 65996 - DNA, 20 bp, Artificial Sequence
  sgRNA
  NTC_1249
tcaacgcgactcgtttcatc

SEQ ID NO: 65997 - DNA, 20 bp, Artificial Sequence
  sgRNA
  NTC_1250
aaacgcgtcgttaacgtctc

SEQ ID NO: 65998 - DNA, 20 bp, Artificial Sequence
  sgRNA
  NTC_1251
ttgacgctacgatcatccta

SEQ ID NO: 65999 - DNA, 20 bp, Artificial Sequence
  sgRNA
  NTC_1252
actcggtaactgttcgatta

SEQ ID NO: 66000 - DNA, 20 bp, Artificial Sequence
  sgRNA
  NTC_1253
aatcgaggcgacgcatcgcg

SEQ ID NO: 66001 - DNA, 20 bp, Artificial Sequence
  sgRNA
  NTC_1254
tacgaggcggtcacgatcgt

SEQ ID NO: 66002 - DNA, 20 bp, Artificial Sequence
  sgRNA
  NTC_1255
gtcgtacggcacttgcgaac

SEQ ID NO: 66003 - DNA, 20 bp, Artificial Sequence
  sgRNA
  NTC_1256
cgacggtagtcgcgattact

SEQ ID NO: 66004 - DNA, 20 bp, Artificial Sequence
  sgRNA
  NTC_1257
ggacatttgtgacgcgtccg

SEQ ID NO: 66005 - DNA, 20 bp, Artificial Sequence
  sgRNA
  NTC_1258
taatagcggacgctccgcga

SEQ ID NO: 66006 - DNA, 20 bp, Artificial Sequence
  sgRNA
  NTC_1259
cgtgtatacgttcacgacag

SEQ ID NO: 66007 - DNA, 20 bp, Artificial Sequence
  sgRNA
  NTC_1260
gcggtctatataccgccgtg

SEQ ID NO: 66008 - DNA, 20 bp, Artificial Sequence
  sgRNA
  NTC_1261
tagattacgcggcgtgttac

SEQ ID NO: 66009 - DNA, 20 bp, Artificial Sequence
  sgRNA
  NTC_1262
gcaacaatagtgcgcgatcc

SEQ ID NO: 66010 - DNA, 20 bp, Artificial Sequence
  sgRNA
  NTC_1263
tcgaatgcgcgcgagcaact

SEQ ID NO: 66011 - DNA, 20 bp, Artificial Sequence
  sgRNA
  NTC_1264
gtgagtcgggagaccgatcg

SEQ ID NO: 66012 - DNA, 20 bp, Artificial Sequence
  sgRNA
  NTC_1265
acaggttcgggcttcgcgca

SEQ ID NO: 66013 - DNA, 20 bp, Artificial Sequence
  sgRNA
  NTC_1266
atcgtagcgacgcttcacgc

SEQ ID NO: 66014 - DNA, 20 bp, Artificial Sequence
  sgRNA
  NTC_1267
aacgagcacgggtcgacaat

SEQ ID NO: 66015 - DNA, 20 bp, Artificial Sequence
  sgRNA
  NTC_1268
tcgaaacgattgacgcgttc

SEQ ID NO: 66016 - DNA, 20 bp, Artificial Sequence
  sgRNA
  NTC_1269
ttatggacggatcgcgcttg

SEQ ID NO: 66017 - DNA, 20 bp, Artificial Sequence
  sgRNA
  NTC_1270
tcaagtgtagctgtccgtcg

SEQ ID NO: 66018 - DNA, 20 bp, Artificial Sequence
  sgRNA
  NTC_1271
agctttcgagcgcgcgctag

SEQ ID NO: 66019 - DNA, 20 bp, Artificial Sequence
  sgRNA
  NTC_1272
ttgatgcgtaatcgacccgc

SEQ ID NO: 66020 - DNA, 20 bp, Artificial Sequence
  sgRNA
  NTC_1273
cgtagcgatcataagtcgac

SEQ ID NO: 66021 - DNA, 20 bp, Artificial Sequence
  sgRNA
  NTC_1274
gcgtaagggttccccgtaat

SEQ ID NO: 66022 - DNA, 20 bp, Artificial Sequence
  sgRNA
  NTC_1275
tgtgactcgtcgacgtacta

SEQ ID NO: 66023 - DNA, 20 bp, Artificial Sequence
  sgRNA
  NTC_1276
gcgtcgctacaaaacgacgt

SEQ ID NO: 66024 - DNA, 20 bp, Artificial Sequence
  sgRNA
  NTC_1277
cactctacgtatgacgacct

SEQ ID NO: 66025 - DNA, 20 bp, Artificial Sequence
  sgRNA
  NTC_1278
tacggcgttattaccgctcc

SEQ ID NO: 66026 - DNA, 20 bp, Artificial Sequence
  sgRNA
  NTC_1279
ggataaaacttgaccgcacc

SEQ ID NO: 66027 - DNA, 20 bp, Artificial Sequence
  sgRNA
  NTC_1280
tgcgatctgtcagtcgccgt

SEQ ID NO: 66028 - DNA, 20 bp, Artificial Sequence
  sgRNA
  NTC_1281
tgcggtacagcgcgcgttag

SEQ ID NO: 66029 - DNA, 20 bp, Artificial Sequence
  sgRNA
  NTC_1282
tctcgcaggtattcgtagtc

SEQ ID NO: 66030 - DNA, 20 bp, Artificial Sequence
  sgRNA
  NTC_1283
ggcaacaagctccgtactcc

SEQ ID NO: 66031 - DNA, 20 bp, Artificial Sequence
  sgRNA
  NTC_1284
aacagtgatgacgtcgcttt

SEQ ID NO: 66032 - DNA, 20 bp, Artificial Sequence
  sgRNA
  NTC_1285
gttagaggcgcgctcctaac

SEQ ID NO: 66033 - DNA, 20 bp, Artificial Sequence
  sgRNA
  NTC_1286
ttcgttgcgtatcgaactgc

SEQ ID NO: 66034 - DNA, 20 bp, Artificial Sequence
  sgRNA
  NTC_1287
tcgcatgcgtcaactcgcca

SEQ ID NO: 66035 - DNA, 20 bp, Artificial Sequence
  sgRNA
  NTC_1288
attctgtagcacgcgacgtt

SEQ ID NO: 66036 - DNA, 20 bp, Artificial Sequence
  sgRNA
  NTC_1289
cgagcgctcgcgtaacgcca

SEQ ID NO: 66037 - DNA, 20 bp, Artificial Sequence
  sgRNA
  NTC_1290
gtctggagtatcgacccgat

SEQ ID NO: 66038 - DNA, 20 bp, Artificial Sequence
  sgRNA
  NTC_1291
aatcgtataatccacgacgc

SEQ ID NO: 66039 - DNA, 20 bp, Artificial Sequence
  sgRNA
  NTC_1292
gtcattgaatcgctaccccc

SEQ ID NO: 66040 - DNA, 20 bp, Artificial Sequence
  sgRNA
  NTC_1293
ttgacgaacatccgccgtga

SEQ ID NO: 66041 - DNA, 20 bp, Artificial Sequence
  sgRNA
  NTC_1294
gatgtaacagtcgccgcgta

SEQ ID NO: 66042 - DNA, 20 bp, Artificial Sequence
  sgRNA
  NTC_1295
caaaaagcaatgtgcgcgtc

SEQ ID NO: 66043 - DNA, 20 bp, Artificial Sequence
  sgRNA
  NTC_1296
gcggctcaatcaccgaaaag

SEQ ID NO: 66044 - DNA, 20 bp, Artificial Sequence
  sgRNA
  NTC_1297
tcaattctagggcgcccgaa

SEQ ID NO: 66045 - DNA, 20 bp, Artificial Sequence
  sgRNA
  NTC_1298
acggtcgttgacgcgcgcta

SEQ ID NO: 66046 - DNA, 20 bp, Artificial Sequence
  sgRNA
  NTC_1299
gcgaaagacgcgtaagtccg

SEQ ID NO: 66047 - DNA, 20 bp, Artificial Sequence
  sgRNA
  NTC_1300
tcgtcgctaagatcgactat

SEQ ID NO: 66048 - DNA, 20 bp, Artificial Sequence
  sgRNA
  NTC_1301
taggataaagcagccgtcgt

SEQ ID NO: 66049 - DNA, 20 bp, Artificial Sequence
  sgRNA
  NTC_1302
gcgtggcacaacgacgatcc

SEQ ID NO: 66050 - DNA, 20 bp, Artificial Sequence
  sgRNA
  NTC_1303
gaattcggctctgcgacgac

SEQ ID NO: 66051 - DNA, 20 bp, Artificial Sequence
  sgRNA
  NTC_1304
tcgcgcacttaaccgtgact

SEQ ID NO: 66052 - DNA, 20 bp, Artificial Sequence
  sgRNA
  NTC_1305
atgcgatcgtttcgctaaca

SEQ ID NO: 66053 - DNA, 20 bp, Artificial Sequence
  sgRNA
  NTC_1306
gatctatctcgcgacagtcg

SEQ ID NO: 66054 - DNA, 20 bp, Artificial Sequence
  sgRNA
  NTC_1307
cacggcgcggcgccaactta

SEQ ID NO: 66055 - DNA, 20 bp, Artificial Sequence
  sgRNA
  NTC_1308
gtacgcgcgttctcccccga

SEQ ID NO: 66056 - DNA, 20 bp, Artificial Sequence
  sgRNA
  NTC_1309
cgtcgtgtgtagcgatcaca

SEQ ID NO: 66057 - DNA, 20 bp, Artificial Sequence
  sgRNA
  NTC_1310
gttgcgtacgactcgctacg

SEQ ID NO: 66058 - DNA, 20 bp, Artificial Sequence
  sgRNA
  NTC_1311
cgatcgtttcgccgacagca

SEQ ID NO: 66059 - DNA, 20 bp, Artificial Sequence
  sgRNA
  NTC_1312
tcttagcgtgatccgcgaat

SEQ ID NO: 66060 - DNA, 20 bp, Artificial Sequence
  sgRNA
  NTC_1313
tctggaatagagcgccgcca

SEQ ID NO: 66061 - DNA, 20 bp, Artificial Sequence
  sgRNA
  NTC_1314
gtggttcagtcaacgatcga

SEQ ID NO: 66062 - DNA, 20 bp, Artificial Sequence
  sgRNA
  NTC_1315
atatagcgcgtagatcgacg

SEQ ID NO: 66063 - DNA, 20 bp, Artificial Sequence
  sgRNA
  NTC_1316
actaatcgtgctcgctacct

SEQ ID NO: 66064 - DNA, 20 bp, Artificial Sequence
  sgRNA
  NTC_1317
acgctaggcggccgctttgc

SEQ ID NO: 66065 - DNA, 20 bp, Artificial Sequence
  sgRNA
  NTC_1318
acggaaatacgccccgctac

SEQ ID NO: 66066 - DNA, 20 bp, Artificial Sequence
  sgRNA
  NTC_1319
tcgaagctaaaccgttcgac

SEQ ID NO: 66067 - DNA, 20 bp, Artificial Sequence
  sgRNA
  NTC_1320
cggtgcgcgaaacctgatag

SEQ ID NO: 66068 - DNA, 20 bp, Artificial Sequence
  sgRNA
  NTC_1321
tggacggtacacgtaagtcg

SEQ ID NO: 66069 - DNA, 20 bp, Artificial Sequence
  sgRNA
  NTC_1322
tatcacacgacgattcagcc

SEQ ID NO: 66070 - DNA, 20 bp, Artificial Sequence
  sgRNA
  NTC_1323
gtgcattaaagtcgataccg

SEQ ID NO: 66071 - DNA, 20 bp, Artificial Sequence
  sgRNA
  NTC_1324
ggtgacgcgcggctcgtgtt

SEQ ID NO: 66072 - DNA, 20 bp, Artificial Sequence
  sgRNA
  NTC_1325
tgcggttcgacgtgacctac

SEQ ID NO: 66073 - DNA, 20 bp, Artificial Sequence
  sgRNA
  NTC_1326
attgcgcataaacctcgttc

SEQ ID NO: 66074 - DNA, 20 bp, Artificial Sequence
  sgRNA
  NTC_1327
gcgactcggttgagcgtctt

SEQ ID NO: 66075 - DNA, 20 bp, Artificial Sequence
  sgRNA
  NTC_1328
tgcgtcttcaaaaccgcgta

SEQ ID NO: 66076 - DNA, 20 bp, Artificial Sequence
  sgRNA
  NTC_1329
aatataacgtttcgtcgcgc

SEQ ID NO: 66077 - DNA, 20 bp, Artificial Sequence
  sgRNA
  NTC_1330
gaggtaatcacgtaaccgtt

SEQ ID NO: 66078 - DNA, 20 bp, Artificial Sequence
  sgRNA
  NTC_1331
aacgggttgtagtcgtacta

SEQ ID NO: 66079 - DNA, 20 bp, Artificial Sequence
  sgRNA
  NTC_1332
acttgggtagtgaccgatcg

SEQ ID NO: 66080 - DNA, 20 bp, Artificial Sequence
  sgRNA
  NTC_1333
gatcactgatcgtctaccac

SEQ ID NO: 66081 - DNA, 20 bp, Artificial Sequence
  sgRNA
  NTC_1334
gacgcgctaacgcgtattct

SEQ ID NO: 66082 - DNA, 20 bp, Artificial Sequence
  sgRNA
  NTC_1335
atcgtcagacgaatccgctt

SEQ ID NO: 66083 - DNA, 20 bp, Artificial Sequence
  sgRNA
  NTC_1336
ctaacgtcgcacccacgact

SEQ ID NO: 66084 - DNA, 20 bp, Artificial Sequence
  sgRNA
  NTC_1337
acgtacggcaaacgaaccgt

SEQ ID NO: 66085 - DNA, 20 bp, Artificial Sequence
  sgRNA
  NTC_1338
tcgatgaacgaacctattac

SEQ ID NO: 66086 - DNA, 20 bp, Artificial Sequence
  sgRNA
  NTC_1339
ttcgacattatagcgacgtt

SEQ ID NO: 66087 - DNA, 20 bp, Artificial Sequence
  sgRNA
  NTC_1340
tctgatgacgcgtctgcgct

SEQ ID NO: 66088 - DNA, 20 bp, Artificial Sequence
  sgRNA
  NTC_1341
tgtatggcgagtgtccgccg

SEQ ID NO: 66089 - DNA, 20 bp, Artificial Sequence
  sgRNA
  NTC_1342
ggtacgagggctcgttctag

SEQ ID NO: 66090 - DNA, 20 bp, Artificial Sequence
  sgRNA
  NTC_1343
cggttcgtatcgaacgaacc

SEQ ID NO: 66091 - DNA, 20 bp, Artificial Sequence
  sgRNA
  NTC_1344
cttgcgcagcttaccgcgtt

SEQ ID NO: 66092 - DNA, 20 bp, Artificial Sequence
  sgRNA
  NTC_1345
cgttggcgatcaatatcgtg

SEQ ID NO: 66093 - DNA, 20 bp, Artificial Sequence
  sgRNA
  NTC_1346
aagctatacgaccgctaacg

SEQ ID NO: 66094 - DNA, 20 bp, Artificial Sequence
  sgRNA
  NTC_1347
cgtagattgcgcactcgaca

SEQ ID NO: 66095 - DNA, 20 bp, Artificial Sequence
  sgRNA
  NTC_1348
cggctgagtcgcccaatgcg

SEQ ID NO: 66096 - DNA, 20 bp, Artificial Sequence
  sgRNA
  NTC_1349
attagtcgctcgcgagatgt

SEQ ID NO: 66097 - DNA, 20 bp, Artificial Sequence
  sgRNA
  NTC_1350
gcttcgcggctcataacccg

SEQ ID NO: 66098 - DNA, 20 bp, Artificial Sequence
  sgRNA
  NTC_1351
gagcgcgtcgactccgcctt

SEQ ID NO: 66099 - DNA, 20 bp, Artificial Sequence
  sgRNA
  NTC_1352
gactatcgagtcgttacgcg

SEQ ID NO: 66100 - DNA, 20 bp, Artificial Sequence
  sgRNA
  NTC_1353
tcataactacgtccgatacg

SEQ ID NO: 66101 - DNA, 20 bp, Artificial Sequence
  sgRNA
  NTC_1354
gcacttgaaacgaccgaagc

SEQ ID NO: 66102 - DNA, 20 bp, Artificial Sequence
  sgRNA
  NTC_1355
gacggggcacttgcgtcgtg

SEQ ID NO: 66103 - DNA, 20 bp, Artificial Sequence
  sgRNA
  NTC_1356
taagaaacgggcgccccccc

SEQ ID NO: 66104 - DNA, 20 bp, Artificial Sequence
  sgRNA
  NTC_1357
cgcacgatttatgcgtccca

SEQ ID NO: 66105 - DNA, 20 bp, Artificial Sequence
  sgRNA
  NTC_1358
aggtggtacaaccgtattac

SEQ ID NO: 66106 - DNA, 20 bp, Artificial Sequence
  sgRNA
  NTC_1359
gacgacgcatgtcgtcgtcg

SEQ ID NO: 66107 - DNA, 20 bp, Artificial Sequence
  sgRNA
  NTC_1360
gacggggaacgtcgcacatt

SEQ ID NO: 66108 - DNA, 20 bp, Artificial Sequence
  sgRNA
  NTC_1361
ggggcgcatcgaaagattaa

SEQ ID NO: 66109 - DNA, 20 bp, Artificial Sequence
  sgRNA
  NTC_1362
ctaatataacgtcgatcgca

SEQ ID NO: 66110 - DNA, 20 bp, Artificial Sequence
  sgRNA
  NTC_1363
cgactgtactcgatacacca

SEQ ID NO: 66111 - DNA, 20 bp, Artificial Sequence
  sgRNA
  NTC_1364
tcggtgtcgtgcgtacagtc

SEQ ID NO: 66112 - DNA, 20 bp, Artificial Sequence
  sgRNA
  NTC_1365
gagacgcacgcgactacacg

SEQ ID NO: 66113 - DNA, 20 bp, Artificial Sequence
  sgRNA
  NTC_1366
gacatgtcattatcgccgcg

SEQ ID NO: 66114 - DNA, 20 bp, Artificial Sequence
  sgRNA
  NTC_1367
cgctgaggtcaagtagcgat

SEQ ID NO: 66115 - DNA, 20 bp, Artificial Sequence
  sgRNA
  NTC_1368
gtacgcacggcgcagctacc

SEQ ID NO: 66116 - DNA, 20 bp, Artificial Sequence
  sgRNA
  NTC_1369
gtcgcgctaagacgttaaac

SEQ ID NO: 66117 - DNA, 20 bp, Artificial Sequence
  sgRNA
  NTC_1370
actattgcgcacccgcgcta

SEQ ID NO: 66118 - DNA, 20 bp, Artificial Sequence
  sgRNA
  NTC_1371
tgtacgaacgactaccgagc

SEQ ID NO: 66119 - DNA, 20 bp, Artificial Sequence
  sgRNA
  NTC_1372
gtagcggcgggacgaagtct

SEQ ID NO: 66120 - DNA, 20 bp, Artificial Sequence
  sgRNA
  NTC_1373
taaagtgactcgttcgctga

SEQ ID NO: 66121 - DNA, 20 bp, Artificial Sequence
  sgRNA
  NTC_1374
gacgttcgtcgactaatcga

SEQ ID NO: 66122 - DNA, 20 bp, Artificial Sequence
  sgRNA
  NTC_1375
cgcgttgttacgcaacttca

SEQ ID NO: 66123 - DNA, 20 bp, Artificial Sequence
  sgRNA
  NTC_1376
gcgggagcagctagtatccg

SEQ ID NO: 66124 - DNA, 20 bp, Artificial Sequence
  sgRNA
  NTC_1377
tacgtgctacgacctcccgt

SEQ ID NO: 66125 - DNA, 20 bp, Artificial Sequence
  sgRNA
  NTC_1378
tacggatcgagtaacccgcg

SEQ ID NO: 66126 - DNA, 20 bp, Artificial Sequence
  sgRNA
  NTC_1379
cgtatcggcatctcaaccta

SEQ ID NO: 66127 - DNA, 20 bp, Artificial Sequence
  sgRNA
  NTC_1380
gtctttcgacgcgccgtacc

SEQ ID NO: 66128 - DNA, 20 bp, Artificial Sequence
  sgRNA
  NTC_1381
gcgcgtgattatgcaatcga

SEQ ID NO: 66129 - DNA, 20 bp, Artificial Sequence
  sgRNA
  NTC_1382
acggacgtcaatatatcgcg

SEQ ID NO: 66130 - DNA, 20 bp, Artificial Sequence
  sgRNA
  NTC_1383
gacggtatcgcgacgcgact

SEQ ID NO: 66131 - DNA, 20 bp, Artificial Sequence
  sgRNA
  NTC_1384
gacttcgtaatgcaacgcga

SEQ ID NO: 66132 - DNA, 20 bp, Artificial Sequence
  sgRNA
  NTC_1385
agcgtgcgaaaccttcgccg

SEQ ID NO: 66133 - DNA, 20 bp, Artificial Sequence
  sgRNA
  NTC_1386
acacaagagcgcaacgtcta

SEQ ID NO: 66134 - DNA, 20 bp, Artificial Sequence
  sgRNA
  NTC_1387
ctgcgttcgtcgatttacga

SEQ ID NO: 66135 - DNA, 20 bp, Artificial Sequence
  sgRNA
  NTC_1388
gacgggtgtcgtatcgaaaa

SEQ ID NO: 66136 - DNA, 20 bp, Artificial Sequence
  sgRNA
  NTC_1389
gcttatttctcgcgacgcaa

SEQ ID NO: 66137 - DNA, 20 bp, Artificial Sequence
  sgRNA
  NTC_1390
gaacgcgcggtcactatgcg

SEQ ID NO: 66138 - DNA, 20 bp, Artificial Sequence
  sgRNA
  NTC_1391
ttagtatgcggtcccgcgct

SEQ ID NO: 66139 - DNA, 20 bp, Artificial Sequence
  sgRNA
  NTC_1392
caatattgcacgattccgcg

SEQ ID NO: 66140 - DNA, 20 bp, Artificial Sequence
  sgRNA
  NTC_1393
gagagctcgattccgcaaat

SEQ ID NO: 66141 - DNA, 20 bp, Artificial Sequence
  sgRNA
  NTC_1394
ctcgttaaaggcacgcgatc

SEQ ID NO: 66142 - DNA, 20 bp, Artificial Sequence
  sgRNA
  NTC_1395
ttcgtactatcgtcgttgcg

SEQ ID NO: 66143 - DNA, 20 bp, Artificial Sequence
  sgRNA
  NTC_1396
acggagcatctccgcgagtc

SEQ ID NO: 66144 - DNA, 20 bp, Artificial Sequence
  sgRNA
  NTC_1397
tctatacggacgtacgacga

SEQ ID NO: 66145 - DNA, 20 bp, Artificial Sequence
  sgRNA
  NTC_1398
attggcactagacgcgccaa

SEQ ID NO: 66146 - DNA, 20 bp, Artificial Sequence
  sgRNA
  NTC_1399
aggaattcggacaccgtttg

SEQ ID NO: 66147 - DNA, 20 bp, Artificial Sequence
  sgRNA
  NTC_1400
gatcgtgcgttcgccccacc

SEQ ID NO: 66148 - DNA, 20 bp, Artificial Sequence
  sgRNA
  NTC_1401
gagtaaagtgtcgtagtacg

SEQ ID NO: 66149 - DNA, 20 bp, Artificial Sequence
  sgRNA
  NTC_1402
ggcggatcgtcagtcgcgca

SEQ ID NO: 66150 - DNA, 20 bp, Artificial Sequence
  sgRNA
  NTC_1403
acgacgggcatcccgcgatc

SEQ ID NO: 66151 - DNA, 20 bp, Artificial Sequence
  sgRNA
  NTC_1404
ggcgagcggcaactaacata

SEQ ID NO: 66152 - DNA, 20 bp, Artificial Sequence
  sgRNA
  NTC_1405
acgctcgcttggcgactatt

SEQ ID NO: 66153 - DNA, 20 bp, Artificial Sequence
  sgRNA
  NTC_1406
aaatcgtcgctcaacatcgc

SEQ ID NO: 66154 - DNA, 20 bp, Artificial Sequence
  sgRNA
  NTC_1407
ctcgtggcgttagcgattag

SEQ ID NO: 66155 - DNA, 20 bp, Artificial Sequence
  sgRNA
  NTC_1408
ggtatcgagtcgcgtagtac

SEQ ID NO: 66156 - DNA, 20 bp, Artificial Sequence
  sgRNA
  NTC_1409
tcgacgttaacgcatcaact

SEQ ID NO: 66157 - DNA, 20 bp, Artificial Sequence
  sgRNA
  NTC_1410
gttcgtaagtatgtcgatct

SEQ ID NO: 66158 - DNA, 20 bp, Artificial Sequence
  sgRNA
  NTC_1411
ctgacacgcgaacatttacg

SEQ ID NO: 66159 - DNA, 20 bp, Artificial Sequence
  sgRNA
  NTC_1412
cataaggcggctttcgcgta

SEQ ID NO: 66160 - DNA, 20 bp, Artificial Sequence
  sgRNA
  NTC_1413
atatgcgcgaagatagacgt

SEQ ID NO: 66161 - DNA, 20 bp, Artificial Sequence
  sgRNA
  NTC_1414
ctctcgcaatcgcgtcgacc

SEQ ID NO: 66162 - DNA, 20 bp, Artificial Sequence
  sgRNA
  NTC_1415
tcgtgggacttctccgtatc

SEQ ID NO: 66163 - DNA, 20 bp, Artificial Sequence
  sgRNA
  NTC_1416
cggagcttcatatcgccgta

SEQ ID NO: 66164 - DNA, 20 bp, Artificial Sequence
  sgRNA
  NTC_1417
cttgtgttatctccgccgaa

SEQ ID NO: 66165 - DNA, 20 bp, Artificial Sequence
  sgRNA
  NTC_1418
ttactgaggcgactcgacat

SEQ ID NO: 66166 - DNA, 20 bp, Artificial Sequence
  sgRNA
  NTC_1419
atcgatcggacgacgcaagt

SEQ ID NO: 66167 - DNA, 20 bp, Artificial Sequence
  sgRNA
  NTC_1420
aggtagctcgatcgcaattt

SEQ ID NO: 66168 - DNA, 20 bp, Artificial Sequence
  sgRNA
  NTC_1421
tgtcgcgacgggcgcttgca

SEQ ID NO: 66169 - DNA, 20 bp, Artificial Sequence
  sgRNA
  NTC_1422
aatagtacggcgacgcgacg

SEQ ID NO: 66170 - DNA, 20 bp, Artificial Sequence
  sgRNA
  NTC_1423
cggcgggacgttccgacagc

SEQ ID NO: 66171 - DNA, 20 bp, Artificial Sequence
  sgRNA
  NTC_1424
gatagtctacattacgcgtg

SEQ ID NO: 66172 - DNA, 20 bp, Artificial Sequence
  sgRNA
  NTC_1425
agctcgtacaatacgccgct

SEQ ID NO: 66173 - DNA, 20 bp, Artificial Sequence
  sgRNA
  NTC_1426
gtgtagcggcagattccgac

SEQ ID NO: 66174 - DNA, 20 bp, Artificial Sequence
  sgRNA
  NTC_1427
gatgtcgataagacgcgctc

SEQ ID NO: 66175 - DNA, 20 bp, Artificial Sequence
  sgRNA
  NTC_1428
attgggcgagatacgattat

SEQ ID NO: 66176 - DNA, 20 bp, Artificial Sequence
  sgRNA
  NTC_1429
gacgcttctattcgatcgaa

SEQ ID NO: 66177 - DNA, 20 bp, Artificial Sequence
  sgRNA
  NTC_1430
ctatcgtaaacgcatcgtcg

SEQ ID NO: 66178 - DNA, 20 bp, Artificial Sequence
  sgRNA
  NTC_1431
gctagcgcaactcgcattat

SEQ ID NO: 66179 - DNA, 20 bp, Artificial Sequence
  sgRNA
  NTC_1432
tatcgcgcgctaatcccaga

SEQ ID NO: 66180 - DNA, 20 bp, Artificial Sequence
  sgRNA
  NTC_1433
gcggttatacgttcgaaccg

SEQ ID NO: 66181 - DNA, 20 bp, Artificial Sequence
  sgRNA
  NTC_1434
cgtgacgacgcatctgcgca

SEQ ID NO: 66182 - DNA, 20 bp, Artificial Sequence
  sgRNA
  NTC_1435
tcgcgacagacgcccctaat

SEQ ID NO: 66183 - DNA, 20 bp, Artificial Sequence
  sgRNA
  NTC_1436
ggatattcgcggcgatcgtg

SEQ ID NO: 66184 - DNA, 20 bp, Artificial Sequence
  sgRNA
  NTC_1437
ggaatcgtcataaccgcgag

SEQ ID NO: 66185 - DNA, 20 bp, Artificial Sequence
  sgRNA
  NTC_1438
ttcgactgaagcgcgcttct

SEQ ID NO: 66186 - DNA, 20 bp, Artificial Sequence
  sgRNA
  NTC_1439
ctagatcggtttgatcgtgt

SEQ ID NO: 66187 - DNA, 20 bp, Artificial Sequence
  sgRNA
  NTC_1440
tgcgactctgatcgatgcga

SEQ ID NO: 66188 - DNA, 20 bp, Artificial Sequence
  sgRNA
  NTC_1441
gagtcgaatcttgaacgcga

SEQ ID NO: 66189 - DNA, 20 bp, Artificial Sequence
  sgRNA
  NTC_1442
cggcgacattatcgctgatc

SEQ ID NO: 66190 - DNA, 20 bp, Artificial Sequence
  sgRNA
  NTC_1443
caggtacatcgttccgccag

SEQ ID NO: 66191 - DNA, 20 bp, Artificial Sequence
  sgRNA
  NTC_1444
caacgtctcgggctcgcgag

SEQ ID NO: 66192 - DNA, 20 bp, Artificial Sequence
  sgRNA
  NTC_1445
acgcggctgctttcgctaat

SEQ ID NO: 66193 - DNA, 20 bp, Artificial Sequence
  sgRNA
  NTC_1446
ttacgatacgctcccgcacg

SEQ ID NO: 66194 - DNA, 20 bp, Artificial Sequence
  sgRNA
  NTC_1447
tctaaaactcgatcgagcga

SEQ ID NO: 66195 - DNA, 20 bp, Artificial Sequence
  sgRNA
  NTC_1448
gtcgaacacgcgtaaacgat

SEQ ID NO: 66196 - DNA, 20 bp, Artificial Sequence
  sgRNA
  NTC_1449
cgcgcgatttctgacgacga

SEQ ID NO: 66197 - DNA, 20 bp, Artificial Sequence
  sgRNA
  NTC_1450
tcgcggttcgcatagtcgtt

SEQ ID NO: 66198 - DNA, 20 bp, Artificial Sequence
  sgRNA
  NTC_1451
ttcgtggacgagacgttact

SEQ ID NO: 66199 - DNA, 20 bp, Artificial Sequence
  sgRNA
  NTC_1452
ggttcgatttcgtttccgac

SEQ ID NO: 66200 - DNA, 20 bp, Artificial Sequence
  sgRNA
  NTC_1453
ttcgcgtgatacgtcaatcg

SEQ ID NO: 66201 - DNA, 20 bp, Artificial Sequence
  sgRNA
  NTC_1454
tcgcgctgctacccccgatt

SEQ ID NO: 66202 - DNA, 20 bp, Artificial Sequence
  sgRNA
  NTC_1455
tcgcaatttcggtcgtcgat

SEQ ID NO: 66203 - DNA, 20 bp, Artificial Sequence
  sgRNA
  NTC_1456
agttagcgcaaacgagcagt

SEQ ID NO: 66204 - DNA, 20 bp, Artificial Sequence
  sgRNA
  NTC_1457
gttaatctaatacgcgaaag

SEQ ID NO: 66205 - DNA, 20 bp, Artificial Sequence
  sgRNA
  NTC_1458
ggtatttcgctctaccgcga

SEQ ID NO: 66206 - DNA, 20 bp, Artificial Sequence
  sgRNA
  NTC_1459
gttcacgagagcaacgacgc

SEQ ID NO: 66207 - DNA, 20 bp, Artificial Sequence
  sgRNA
  NTC_1460
aacgcagtcgctaacttata

SEQ ID NO: 66208 - DNA, 20 bp, Artificial Sequence
  sgRNA
  NTC_1461
gcgaatggattatgcgaatc

SEQ ID NO: 66209 - DNA, 20 bp, Artificial Sequence
  sgRNA
  NTC_1462
tgatgatcggggtacgaaac

SEQ ID NO: 66210 - DNA, 20 bp, Artificial Sequence
  sgRNA
  NTC_1463
ttaattaagcgctaccctcg

SEQ ID NO: 66211 - DNA, 20 bp, Artificial Sequence
  sgRNA
  NTC_1464
tttgaacgcaatcgcgaaat

SEQ ID NO: 66212 - DNA, 20 bp, Artificial Sequence
  sgRNA
  NTC_1465
tgagcggcgtatccgtcacc

SEQ ID NO: 66213 - DNA, 20 bp, Artificial Sequence
  sgRNA
  NTC_1466
atagtaggtgcgccgccgtt

SEQ ID NO: 66214 - DNA, 20 bp, Artificial Sequence
  sgRNA
  NTC_1467
cggtggtctttcgacgattc

SEQ ID NO: 66215 - DNA, 20 bp, Artificial Sequence
  sgRNA
  NTC_1468
ggcgcacttaattcgtccga

SEQ ID NO: 66216 - DNA, 20 bp, Artificial Sequence
  sgRNA
  NTC_1469
ctagtgcacgatcgcgcgcg

SEQ ID NO: 66217 - DNA, 20 bp, Artificial Sequence
  sgRNA
  NTC_1470
tgtctcgatacgtcgtagcg

SEQ ID NO: 66218 - DNA, 20 bp, Artificial Sequence
  sgRNA
  NTC_1471
agtagtatgtctcgcgttcg

SEQ ID NO: 66219 - DNA, 20 bp, Artificial Sequence
  sgRNA
  NTC_1472
ggtgcgatggtattcgccgt

SEQ ID NO: 66220 - DNA, 20 bp, Artificial Sequence
  sgRNA
  NTC_1473
gactaggttgatcacgcgcg

SEQ ID NO: 66221 - DNA, 20 bp, Artificial Sequence
  sgRNA
  NTC_1474
tcgctcttggaccgcctatg

SEQ ID NO: 66222 - DNA, 20 bp, Artificial Sequence
  sgRNA
  NTC_1475
ataaagatcgatcgtcgcta

SEQ ID NO: 66223 - DNA, 20 bp, Artificial Sequence
  sgRNA
  NTC_1476
cgcgttaggcgtgtatagtc

SEQ ID NO: 66224 - DNA, 20 bp, Artificial Sequence
  sgRNA
  NTC_1477
gcgatgtcttaccgttcaat

SEQ ID NO: 66225 - DNA, 20 bp, Artificial Sequence
  sgRNA
  NTC_1478
tcgcggcaggagcccgatta

SEQ ID NO: 66226 - DNA, 20 bp, Artificial Sequence
  sgRNA
  NTC_1479
tcacgacggacgtgctcgct

SEQ ID NO: 66227 - DNA, 20 bp, Artificial Sequence
  sgRNA
  NTC_1480
tagatggatgtactcgagcg

SEQ ID NO: 66228 - DNA, 20 bp, Artificial Sequence
  sgRNA
  NTC_1481
agcgagtcgtcgtaatatta

SEQ ID NO: 66229 - DNA, 20 bp, Artificial Sequence
  sgRNA
  NTC_1482
gagttgtagtaccagacgcc

SEQ ID NO: 66230 - DNA, 20 bp, Artificial Sequence
  sgRNA
  NTC_1483
acggactagacaacgtcgca

SEQ ID NO: 66231 - DNA, 20 bp, Artificial Sequence
  sgRNA
  NTC_1484
agcgaagacgggtatagtcg

SEQ ID NO: 66232 - DNA, 20 bp, Artificial Sequence
  sgRNA
  NTC_1485
aaatctaacttcgattgccg

SEQ ID NO: 66233 - DNA, 20 bp, Artificial Sequence
  sgRNA
  NTC_1486
agggttaacaaacttcgcgc

SEQ ID NO: 66234 - DNA, 20 bp, Artificial Sequence
  sgRNA
  NTC_1487
aaagggagtcgacgtacgcg

SEQ ID NO: 66235 - DNA, 20 bp, Artificial Sequence
  sgRNA
  NTC_1488
cgacgatcgacagccgcgaa

SEQ ID NO: 66236 - DNA, 20 bp, Artificial Sequence
  sgRNA
  NTC_1489
attcgacgctcacgtcgacc

SEQ ID NO: 66237 - DNA, 20 bp, Artificial Sequence
  sgRNA
  NTC_1490
gcacgcgcgcatcgtatacg

SEQ ID NO: 66238 - DNA, 20 bp, Artificial Sequence
  sgRNA
  NTC_1491
acggtgtagtagccgatcta

SEQ ID NO: 66239 - DNA, 20 bp, Artificial Sequence
  sgRNA
  NTC_1492
tcttacagcgttccgctact

SEQ ID NO: 66240 - DNA, 20 bp, Artificial Sequence
  sgRNA
  NTC_1493
cactcgcgagcgccgttgat

SEQ ID NO: 66241 - DNA, 20 bp, Artificial Sequence
  sgRNA
  NTC_1494
tcgtgctactagcgcacatt

SEQ ID NO: 66242 - DNA, 20 bp, Artificial Sequence
  sgRNA
  NTC_1495
cgacttaagaaaccgcgcga

SEQ ID NO: 66243 - DNA, 20 bp, Artificial Sequence
  sgRNA
  NTC_1496
agggttacgagcctaacgac

SEQ ID NO: 66244 - DNA, 20 bp, Artificial Sequence
  sgRNA
  NTC_1497
gcgaggtgatgcacgacaac

SEQ ID NO: 66245 - DNA, 20 bp, Artificial Sequence
  sgRNA
  NTC_1498
tcgtgcagcagataacgcgc

SEQ ID NO: 66246 - DNA, 20 bp, Artificial Sequence
  sgRNA
  NTC_1499
gctcattggcggccgttcgt

SEQ ID NO: 66247 - DNA, 20 bp, Artificial Sequence
  sgRNA
  NTC_1500
gtagtatgctctcgcataga

SEQ ID NO: 66248 - DNA, 20 bp, Artificial Sequence
  sgRNA
  NTC_1501
gcgcataggcgacatccgac

SEQ ID NO: 66249 - DNA, 20 bp, Artificial Sequence
  sgRNA
  NTC_1502
gctcggaacgactttcgcgc

SEQ ID NO: 66250 - DNA, 20 bp, Artificial Sequence
  sgRNA
  NTC_1503
tgtacaagtcggaccgccat

SEQ ID NO: 66251 - DNA, 20 bp, Artificial Sequence
  sgRNA
  NTC_1504
gcgatggcggcgccgtcttt

SEQ ID NO: 66252 - DNA, 20 bp, Artificial Sequence
  sgRNA
  NTC_1505
gatgcgcaatcgaaactact

SEQ ID NO: 66253 - DNA, 20 bp, Artificial Sequence
  sgRNA
  NTC_1506
ttcgcacgattaatcgctag

SEQ ID NO: 66254 - DNA, 20 bp, Artificial Sequence
  sgRNA
  NTC_1507
tcgctgtcataccacgcgca

SEQ ID NO: 66255 - DNA, 20 bp, Artificial Sequence
  sgRNA
  NTC_1508
agcggcttaagttcgcgcat

SEQ ID NO: 66256 - DNA, 20 bp, Artificial Sequence
  sgRNA
  NTC_1509
tcgcacgctgtcgcatgtcg

SEQ ID NO: 66257 - DNA, 20 bp, Artificial Sequence
  sgRNA
  NTC_1510
aactcggcgatccgcgcaat

SEQ ID NO: 66258 - DNA, 20 bp, Artificial Sequence
  sgRNA
  NTC_1511
gttcacggatttcgcgccaa

SEQ ID NO: 66259 - DNA, 20 bp, Artificial Sequence
  sgRNA
  NTC_1512
acgcgagggcgtgctcatcg

SEQ ID NO: 66260 - DNA, 20 bp, Artificial Sequence
  sgRNA
  NTC_1513
agcggacgtgttaccgcctc

SEQ ID NO: 66261 - DNA, 20 bp, Artificial Sequence
  sgRNA
  NTC_1514
ctcgcggtagttatcgtgta

SEQ ID NO: 66262 - DNA, 20 bp, Artificial Sequence
  sgRNA
  NTC_1515
gagcgcgacgacgcatttat

SEQ ID NO: 66263 - DNA, 20 bp, Artificial Sequence
  sgRNA
  NTC_1516
ctcgacggcattcgcgtttc

SEQ ID NO: 66264 - DNA, 20 bp, Artificial Sequence
  sgRNA
  NTC_1517
cgcgacttagatgtcgaaag

SEQ ID NO: 66265 - DNA, 20 bp, Artificial Sequence
  sgRNA
  NTC_1518
cgcgcgagatacttgccgcc

SEQ ID NO: 66266 - DNA, 20 bp, Artificial Sequence
  sgRNA
  NTC_1519
gactctacgagacgacgact

SEQ ID NO: 66267 - DNA, 20 bp, Artificial Sequence
  sgRNA
  NTC_1520
tttatgcggcacgtcgtacg

SEQ ID NO: 66268 - DNA, 20 bp, Artificial Sequence
  sgRNA
  NTC_1521
gcgcgtagcgaacatacccc

SEQ ID NO: 66269 - DNA, 20 bp, Artificial Sequence
  sgRNA
  NTC_1522
cgaaggctgcgacgatcgcg

SEQ ID NO: 66270 - DNA, 20 bp, Artificial Sequence
  sgRNA
  NTC_1523
acgtaatcgtgtaccgatta

SEQ ID NO: 66271 - DNA, 20 bp, Artificial Sequence
  sgRNA
  NTC_1524
atcggttgagcttccgcgag

SEQ ID NO: 66272 - DNA, 20 bp, Artificial Sequence
  sgRNA
  NTC_1525
ttcgcggacggatccgttac

SEQ ID NO: 66273 - DNA, 20 bp, Artificial Sequence
  sgRNA
  NTC_1526
acgctagtcgcgacccccta

SEQ ID NO: 66274 - DNA, 20 bp, Artificial Sequence
  sgRNA
  NTC_1527
acttaagctgaatcgaccgc

SEQ ID NO: 66275 - DNA, 20 bp, Artificial Sequence
  sgRNA
  NTC_1528
gaggattaacacgcgcgtac

SEQ ID NO: 66276 - DNA, 20 bp, Artificial Sequence
  sgRNA
  NTC_1529
cgataggatagcgacgccac

SEQ ID NO: 66277 - DNA, 20 bp, Artificial Sequence
  sgRNA
  NTC_1530
cggtctgcggacgatccgac

SEQ ID NO: 66278 - DNA, 20 bp, Artificial Sequence
  sgRNA
  NTC_1531
cttatttcgctcgacagtcg

SEQ ID NO: 66279 - DNA, 20 bp, Artificial Sequence
  sgRNA
  NTC_1532
atctgtagtcgcgtcacgaa

SEQ ID NO: 66280 - DNA, 20 bp, Artificial Sequence
  sgRNA
  NTC_1533
gcggcgtcggtcacgcgatc

SEQ ID NO: 66281 - DNA, 20 bp, Artificial Sequence
  sgRNA
  NTC_1534
tgtgcaatactcgtcgaacg

SEQ ID NO: 66282 - DNA, 20 bp, Artificial Sequence
  sgRNA
  NTC_1535
tggggacgcgcgactaccta

SEQ ID NO: 66283 - DNA, 20 bp, Artificial Sequence
  sgRNA
  NTC_1536
acgctacgtcgcgatatcct

SEQ ID NO: 66284 - DNA, 20 bp, Artificial Sequence
  sgRNA
  NTC_1537
tgtacactaggcatcgcccg

SEQ ID NO: 66285 - DNA, 20 bp, Artificial Sequence
  sgRNA
  NTC_1538
attgcatcgtcgaatagcgt

SEQ ID NO: 66286 - DNA, 20 bp, Artificial Sequence
  sgRNA
  NTC_1539
gggtcacttacgctatcacg

SEQ ID NO: 66287 - DNA, 20 bp, Artificial Sequence
  sgRNA
  NTC_1540
tacacgtcgctacccgtagt

SEQ ID NO: 66288 - DNA, 20 bp, Artificial Sequence
  sgRNA
  NTC_1541
acatttacgtctcgcacgtc

SEQ ID NO: 66289 - DNA, 20 bp, Artificial Sequence
  sgRNA
  NTC_1542
tgcgcgaagtactagcgtca

SEQ ID NO: 66290 - DNA, 20 bp, Artificial Sequence
  sgRNA
  NTC_1543
tggtaatcgcaagtaaaacg

SEQ ID NO: 66291 - DNA, 20 bp, Artificial Sequence
  sgRNA
  NTC_1544
cgttgctggtttgccgaagt

SEQ ID NO: 66292 - DNA, 20 bp, Artificial Sequence
  sgRNA
  NTC_1545
agtcgcgtggtcgagtacgc

SEQ ID NO: 66293 - DNA, 20 bp, Artificial Sequence
  sgRNA
  NTC_1546
gcacgattcgcacgagctcg

SEQ ID NO: 66294 - DNA, 20 bp, Artificial Sequence
  sgRNA
  NTC_1547
ggcacgcaactacgccgcaa

SEQ ID NO: 66295 - DNA, 20 bp, Artificial Sequence
  sgRNA
  NTC_1548
ggcgtcgcgaagctcgcgac

SEQ ID NO: 66296 - DNA, 20 bp, Artificial Sequence
  sgRNA
  NTC_1549
ggattggacaacgttcgata

SEQ ID NO: 66297 - DNA, 20 bp, Artificial Sequence
  sgRNA
  NTC_1550
caggtcgcgcgactcactat

SEQ ID NO: 66298 - DNA, 20 bp, Artificial Sequence
  sgRNA
  NTC_1551
atggacgaatattgctcgtc

SEQ ID NO: 66299 - DNA, 20 bp, Artificial Sequence
  sgRNA
  NTC_1552
tcggtcgaagtctccgcgac

SEQ ID NO: 66300 - DNA, 20 bp, Artificial Sequence
  sgRNA
  NTC_1553
agtgcataacatacgtcgta

SEQ ID NO: 66301 - DNA, 20 bp, Artificial Sequence
  sgRNA
  NTC_1554
ttacgcgcggcgttgtgtaa

SEQ ID NO: 66302 - DNA, 20 bp, Artificial Sequence
  sgRNA
  NTC_1555
atgtaagtgtattgcgctcc

SEQ ID NO: 66303 - DNA, 20 bp, Artificial Sequence
  sgRNA
  NTC_1556
tgattaattgaagccgatca

SEQ ID NO: 66304 - DNA, 20 bp, Artificial Sequence
  sgRNA
  NTC_1557
atatcgtatgcgtcgtgact

SEQ ID NO: 66305 - DNA, 20 bp, Artificial Sequence
  sgRNA
  NTC_1558
gcgtttgatcgccgagcgcc

SEQ ID NO: 66306 - DNA, 20 bp, Artificial Sequence
  sgRNA
  NTC_1559
ggcaaggcgacgcacttatg

SEQ ID NO: 66307 - DNA, 20 bp, Artificial Sequence
  sgRNA
  NTC_1560
tgagttaattacgctacatg

SEQ ID NO: 66308 - DNA, 20 bp, Artificial Sequence
  sgRNA
  NTC_1561
gcgcggcagtcttgctaacg

SEQ ID NO: 66309 - DNA, 20 bp, Artificial Sequence
  sgRNA
  NTC_1562
cttcgaacggatcgtgttag

SEQ ID NO: 66310 - DNA, 20 bp, Artificial Sequence
  sgRNA
  NTC_1563
cgttctcggtcgatgtatta

SEQ ID NO: 66311 - DNA, 20 bp, Artificial Sequence
  sgRNA
  NTC_1564
acgcgtgcagcgaacgcgtt

SEQ ID NO: 66312 - DNA, 20 bp, Artificial Sequence
  sgRNA
  NTC_1565
ggtcgatgtgatattcgctc

SEQ ID NO: 66313 - DNA, 20 bp, Artificial Sequence
  sgRNA
  NTC_1566
gtgtaacgaggacgaatcgc

SEQ ID NO: 66314 - DNA, 20 bp, Artificial Sequence
  sgRNA
  NTC_1567
taatgcggtcgcagcgacaa

SEQ ID NO: 66315 - DNA, 20 bp, Artificial Sequence
  sgRNA
  NTC_1568
gtagtagcgcgaatcccata

SEQ ID NO: 66316 - DNA, 20 bp, Artificial Sequence
  sgRNA
  NTC_1569
aaagtctgagctttcgcgca

SEQ ID NO: 66317 - DNA, 20 bp, Artificial Sequence
  sgRNA
  NTC_1570
tcgcgtaaaaaacgcgcgtc

SEQ ID NO: 66318 - DNA, 20 bp, Artificial Sequence
  sgRNA
  NTC_1571
cgtttattagcaaccttacg

SEQ ID NO: 66319 - DNA, 20 bp, Artificial Sequence
  sgRNA
  NTC_1572
tatgggttacagatcgtccg

SEQ ID NO: 66320 - DNA, 20 bp, Artificial Sequence
  sgRNA
  NTC_1573
tgtcggtctcgcacactaat

SEQ ID NO: 66321 - DNA, 20 bp, Artificial Sequence
  sgRNA
  NTC_1574
ttggtagcgggaccgaatta

SEQ ID NO: 66322 - DNA, 20 bp, Artificial Sequence
  sgRNA
  NTC_1575
cgcgatcgtggatcatcaac

SEQ ID NO: 66323 - DNA, 20 bp, Artificial Sequence
  sgRNA
  NTC_1576
ttatcggcgtggacgtgccg

SEQ ID NO: 66324 - DNA, 20 bp, Artificial Sequence
  sgRNA
  NTC_1577
gttggatcagcgtacgcacg

SEQ ID NO: 66325 - DNA, 20 bp, Artificial Sequence
  sgRNA
  NTC_1578
aggtagagaatcgtcgtagc

SEQ ID NO: 66326 - DNA, 20 bp, Artificial Sequence
  sgRNA
  NTC_1579
ttacaacgacggttacgtcg

SEQ ID NO: 66327 - DNA, 20 bp, Artificial Sequence
  sgRNA
  NTC_1580
gcaacgtactgtacgtcccc

SEQ ID NO: 66328 - DNA, 20 bp, Artificial Sequence
  sgRNA
  NTC_1581
caggtttcgcagatatcgaa

SEQ ID NO: 66329 - DNA, 20 bp, Artificial Sequence
  sgRNA
  NTC_1582
ctcgagacggtcgatgtatc

SEQ ID NO: 66330 - DNA, 20 bp, Artificial Sequence
  sgRNA
  NTC_1583
ctgcggaatatcaccgcata

SEQ ID NO: 66331 - DNA, 20 bp, Artificial Sequence
  sgRNA
  NTC_1584
ggcatgggtttaccgaatcg

SEQ ID NO: 66332 - DNA, 20 bp, Artificial Sequence
  sgRNA
  NTC_1585
agtacactggcgcgttacca

SEQ ID NO: 66333 - DNA, 20 bp, Artificial Sequence
  sgRNA
  NTC_1586
gaatagtcggtcgacctcgt

SEQ ID NO: 66334 - DNA, 20 bp, Artificial Sequence
  sgRNA
  NTC_1587
tcacgcaaaacgacgactta

SEQ ID NO: 66335 - DNA, 20 bp, Artificial Sequence
  sgRNA
  NTC_1588
aggtttaaattatacgcgtc

SEQ ID NO: 66336 - DNA, 20 bp, Artificial Sequence
  sgRNA
  NTC_1589
gtcgggggggaccgcgtata

SEQ ID NO: 66337 - DNA, 20 bp, Artificial Sequence
  sgRNA
  NTC_1590
atcgacggggagcgtcaacc

SEQ ID NO: 66338 - DNA, 20 bp, Artificial Sequence
  sgRNA
  NTC_1591
gggaatggactccgcgtagt

SEQ ID NO: 66339 - DNA, 20 bp, Artificial Sequence
  sgRNA
  NTC_1592
gggttacgtaaccctacgtt

SEQ ID NO: 66340 - DNA, 20 bp, Artificial Sequence
  sgRNA
  NTC_1593
cgattgctaacgacgccctc

SEQ ID NO: 66341 - DNA, 20 bp, Artificial Sequence
  sgRNA
  NTC_1594
cggttgcgagaattcgctcg

SEQ ID NO: 66342 - DNA, 20 bp, Artificial Sequence
  sgRNA
  NTC_1595
gggttattatactgcgtccg

SEQ ID NO: 66343 - DNA, 20 bp, Artificial Sequence
  sgRNA
  NTC_1596
catttcgatttgcgcgcgta

SEQ ID NO: 66344 - DNA, 20 bp, Artificial Sequence
  sgRNA
  NTC_1597
gcgatggtgttacgaagtag

SEQ ID NO: 66345 - DNA, 20 bp, Artificial Sequence
  sgRNA
  NTC_1598
acggtgaagtgcgttatgcc

SEQ ID NO: 66346 - DNA, 20 bp, Artificial Sequence
  sgRNA
  NTC_1599
taggataggcgcgatgcgag

SEQ ID NO: 66347 - DNA, 20 bp, Artificial Sequence
  sgRNA
  NTC_1600
ctggtttcgcgtaatacgcc

SEQ ID NO: 66348 - DNA, 20 bp, Artificial Sequence
  sgRNA
  NTC_1601
ggagacggtcgcgtacgctt

SEQ ID NO: 66349 - DNA, 20 bp, Artificial Sequence
  sgRNA
  NTC_1602
caagcgcgcggtaccgttaa

SEQ ID NO: 66350 - DNA, 20 bp, Artificial Sequence
  sgRNA
  NTC_1603
ggagcgagttacttcgaacg

SEQ ID NO: 66351 - DNA, 20 bp, Artificial Sequence
  sgRNA
  NTC_1604
cgcggaacatatccgtccgt

SEQ ID NO: 66352 - DNA, 20 bp, Artificial Sequence
  sgRNA
  NTC_1605
cgtagctaaatcgtatcgac

SEQ ID NO: 66353 - DNA, 20 bp, Artificial Sequence
  sgRNA
  NTC_1606
tatattaggacgtccgtacg

SEQ ID NO: 66354 - DNA, 20 bp, Artificial Sequence
  sgRNA
  NTC_1607
cgattggcatgacgctagcg

SEQ ID NO: 66355 - DNA, 20 bp, Artificial Sequence
  sgRNA
  NTC_1608
ctaacgcggcagagtccgtt

SEQ ID NO: 66356 - DNA, 20 bp, Artificial Sequence
  sgRNA
  NTC_1609
gtcgagttgcatagcgtgtt

SEQ ID NO: 66357 - DNA, 20 bp, Artificial Sequence
  sgRNA
  NTC_1610
gggggtcgtatacgctccga

SEQ ID NO: 66358 - DNA, 20 bp, Artificial Sequence
  sgRNA
  NTC_1611
aatacgcgtgattacgctcc

SEQ ID NO: 66359 - DNA, 20 bp, Artificial Sequence
  sgRNA
  NTC_1612
tagggtatacgacgtacgac

SEQ ID NO: 66360 - DNA, 20 bp, Artificial Sequence
  sgRNA
  NTC_1613
tcgtaagcgtgcacgctttg

SEQ ID NO: 66361 - DNA, 20 bp, Artificial Sequence
  sgRNA
  NTC_1614
tcgactgcggtgttgcgata

SEQ ID NO: 66362 - DNA, 20 bp, Artificial Sequence
  sgRNA
  NTC_1615
taaatgggcactagcgcgtc

SEQ ID NO: 66363 - DNA, 20 bp, Artificial Sequence
  sgRNA
  NTC_1616
cgtgtagatagtcgcgatat

SEQ ID NO: 66364 - DNA, 20 bp, Artificial Sequence
  sgRNA
  NTC_1617
acgacggagacgaacaattt

SEQ ID NO: 66365 - DNA, 20 bp, Artificial Sequence
  sgRNA
  NTC_1618
gcgcttcggagcgacaataa

SEQ ID NO: 66366 - DNA, 20 bp, Artificial Sequence
  sgRNA
  NTC_1619
cgtgcgaggcgccgtttact

SEQ ID NO: 66367 - DNA, 20 bp, Artificial Sequence
  sgRNA
  NTC_1620
gggtaaagatagcgcgagct

SEQ ID NO: 66368 - DNA, 20 bp, Artificial Sequence
  sgRNA
  NTC_1621
cacaatatgttcgtcgccta

SEQ ID NO: 66369 - DNA, 20 bp, Artificial Sequence
  sgRNA
  NTC_1622
gctgtgcaaaacgcgtatcc

SEQ ID NO: 66370 - DNA, 20 bp, Artificial Sequence
  sgRNA
  NTC_1623
cttacgactttcgcaatttc

SEQ ID NO: 66371 - DNA, 20 bp, Artificial Sequence
  sgRNA
  NTC_1624
attcggcttaaaagcccgta

SEQ ID NO: 66372 - DNA, 20 bp, Artificial Sequence
  sgRNA
  NTC_1625
gcgtgcgagacgttaaattg

SEQ ID NO: 66373 - DNA, 20 bp, Artificial Sequence
  sgRNA
  NTC_1626
cgtattcgggggcccgcgac

SEQ ID NO: 66374 - DNA, 20 bp, Artificial Sequence
  sgRNA
  NTC_1627
gtgggacatggaccgccgac

SEQ ID NO: 66375 - DNA, 20 bp, Artificial Sequence
  sgRNA
  NTC_1628
cgaaaggttacgcgttacta

SEQ ID NO: 66376 - DNA, 20 bp, Artificial Sequence
  sgRNA
  NTC_1629
gaatcagggtcgcctaaacg

SEQ ID NO: 66377 - DNA, 20 bp, Artificial Sequence
  sgRNA
  NTC_1630
acggacgtgtcgtcccgtac

SEQ ID NO: 66378 - DNA, 20 bp, Artificial Sequence
  sgRNA
  NTC_1631
agaatgcacgtccgacgacg

SEQ ID NO: 66379 - DNA, 20 bp, Artificial Sequence
  sgRNA
  NTC_1632
tcgtacgattattaccgtgc

SEQ ID NO: 66380 - DNA, 20 bp, Artificial Sequence
  sgRNA
  NTC_1633
catactttgtacgcgacact

SEQ ID NO: 66381 - DNA, 20 bp, Artificial Sequence
  sgRNA
  NTC_1634
tagcgcgtagcaatgcctat

SEQ ID NO: 66382 - DNA, 20 bp, Artificial Sequence
  sgRNA
  NTC_1635
acggtcggtctatcacgact

SEQ ID NO: 66383 - DNA, 20 bp, Artificial Sequence
  sgRNA
  NTC_1636
caatagcggttgccgactaa

SEQ ID NO: 66384 - DNA, 20 bp, Artificial Sequence
  sgRNA
  NTC_1637
cggtatggacgaagttcaat

SEQ ID NO: 66385 - DNA, 20 bp, Artificial Sequence
  sgRNA
  NTC_1638
ggctactcgttgtaccgcgc

SEQ ID NO: 66386 - DNA, 20 bp, Artificial Sequence
  sgRNA
  NTC_1639
tatactaggcgcgacgttgc

SEQ ID NO: 66387 - DNA, 20 bp, Artificial Sequence
  sgRNA
  NTC_1640
gtcgtacgaatcgctgacta

SEQ ID NO: 66388 - DNA, 20 bp, Artificial Sequence
  sgRNA
  NTC_1641
catacgggattcgccgcgcg

SEQ ID NO: 66389 - DNA, 20 bp, Artificial Sequence
  sgRNA
  NTC_1642
gcgtcggactacaagacttt

SEQ ID NO: 66390 - DNA, 20 bp, Artificial Sequence
  sgRNA
  NTC_1643
ctcgcgaatcgccgcccgtg

SEQ ID NO: 66391 - DNA, 20 bp, Artificial Sequence
  sgRNA
  NTC_1644
gaatcacgtaatagcgagtt

SEQ ID NO: 66392 - DNA, 20 bp, Artificial Sequence
  sgRNA
  NTC_1645
tcggatcgcgagcgacgtac

SEQ ID NO: 66393 - DNA, 20 bp, Artificial Sequence
  sgRNA
  NTC_1646
ttatgtcggagtacgacgac

SEQ ID NO: 66394 - DNA, 20 bp, Artificial Sequence
  sgRNA
  NTC_1647
ggcgtacatcttcgtcgact

SEQ ID NO: 66395 - DNA, 20 bp, Artificial Sequence
  sgRNA
  NTC_1648
aaacggatctcgacgtcgtc

SEQ ID NO: 66396 - DNA, 20 bp, Artificial Sequence
  sgRNA
  NTC_1649
attcagctgcgacgcgacag

SEQ ID NO: 66397 - DNA, 20 bp, Artificial Sequence
  sgRNA
  NTC_1650
ttgatatttcgcgtcgccgt

SEQ ID NO: 66398 - DNA, 20 bp, Artificial Sequence
  sgRNA
  NTC_1651
cttagttggcgacagtgcga

SEQ ID NO: 66399 - DNA, 20 bp, Artificial Sequence
  sgRNA
  NTC_1652
ttcgcgaaagagtgtacgag

SEQ ID NO: 66400 - DNA, 20 bp, Artificial Sequence
  sgRNA
  NTC_1653
gactgcgcgaactaatacgc

SEQ ID NO: 66401 - DNA, 20 bp, Artificial Sequence
  sgRNA
  NTC_1654
gcgtcggcgctcgcaattag

SEQ ID NO: 66402 - DNA, 20 bp, Artificial Sequence
  sgRNA
  NTC_1655
cattggacggaaccgtgccc

SEQ ID NO: 66403 - DNA, 20 bp, Artificial Sequence
  sgRNA
  NTC_1656
ttcgcatagtgccgattgtc

SEQ ID NO: 66404 - DNA, 20 bp, Artificial Sequence
  sgRNA
  NTC_1657
ctgaacgcgcgcaataattc

SEQ ID NO: 66405 - DNA, 20 bp, Artificial Sequence
  sgRNA
  NTC_1658
gggtcgctaacgctcgtgag

SEQ ID NO: 66406 - DNA, 20 bp, Artificial Sequence
  sgRNA
  NTC_1659
gcgtcggaatacacgatgta

SEQ ID NO: 66407 - DNA, 20 bp, Artificial Sequence
  sgRNA
  NTC_1660
tagcttgaggtatcacgccg

SEQ ID NO: 66408 - DNA, 20 bp, Artificial Sequence
  sgRNA
  NTC_1661
gatcatcacgcgctcgttct

SEQ ID NO: 66409 - DNA, 20 bp, Artificial Sequence
  sgRNA
  NTC_1662
atgggcgcatcgcgatagtc

SEQ ID NO: 66410 - DNA, 20 bp, Artificial Sequence
  sgRNA
  NTC_1663
agcacgtcatggatcgcgtc

SEQ ID NO: 66411 - DNA, 20 bp, Artificial Sequence
  sgRNA
  NTC_1664
gaaagtatcaacgtcgtcga

SEQ ID NO: 66412 - DNA, 20 bp, Artificial Sequence
  sgRNA
  NTC_1665
aatgctcgtgcacgagatgc

SEQ ID NO: 66413 - DNA, 20 bp, Artificial Sequence
  sgRNA
  NTC_1666
agtaattcggtagcgcaacg

SEQ ID NO: 66414 - DNA, 20 bp, Artificial Sequence
  sgRNA
  NTC_1667
ttgtcgtcgtagcctagatc

SEQ ID NO: 66415 - DNA, 20 bp, Artificial Sequence
  sgRNA
  NTC_1668
gcagtctttacgtacgagat

SEQ ID NO: 66416 - DNA, 20 bp, Artificial Sequence
  sgRNA
  NTC_1669
gcggtagcgtaatcgcctac

SEQ ID NO: 66417 - DNA, 20 bp, Artificial Sequence
  sgRNA
  NTC_1670
agacggttcacgccgcgtta

SEQ ID NO: 66418 - DNA, 20 bp, Artificial Sequence
  sgRNA
  NTC_1671
ggctagtcgacagtacgaat

SEQ ID NO: 66419 - DNA, 20 bp, Artificial Sequence
  sgRNA
  NTC_1672
acttcgcgcacgaccgtttc

SEQ ID NO: 66420 - DNA, 20 bp, Artificial Sequence
  sgRNA
  NTC_1673
tacttcaggcgcgcaacgtt

SEQ ID NO: 66421 - DNA, 20 bp, Artificial Sequence
  sgRNA
  NTC_1674
ggatttcttacgtccgcctc

SEQ ID NO: 66422 - DNA, 20 bp, Artificial Sequence
  sgRNA
  NTC_1675
cgcgtgatgcaaccctacta

SEQ ID NO: 66423 - DNA, 20 bp, Artificial Sequence
  sgRNA
  NTC_1676
tatattgtcaggcgcgatac

SEQ ID NO: 66424 - DNA, 20 bp, Artificial Sequence
  sgRNA
  NTC_1677
tcgtagtatgaccgccgtta

SEQ ID NO: 66425 - DNA, 20 bp, Artificial Sequence
  sgRNA
  NTC_1678
tttctacttagcgatgcgcg

SEQ ID NO: 66426 - DNA, 20 bp, Artificial Sequence
  sgRNA
  NTC_1679
ataacgtacgatgtgcctcg

SEQ ID NO: 66427 - DNA, 20 bp, Artificial Sequence
  sgRNA
  NTC_1680
atagtgctaaggcgccttat

SEQ ID NO: 66428 - DNA, 20 bp, Artificial Sequence
  sgRNA
  NTC_1681
atcgttcgatcgcccgctta

SEQ ID NO: 66429 - DNA, 20 bp, Artificial Sequence
  sgRNA
  NTC_1682
acaatcgtggcgcttatgca

SEQ ID NO: 66430 - DNA, 20 bp, Artificial Sequence
  sgRNA
  NTC_1683
ctgcttcgacgatacgcact

SEQ ID NO: 66431 - DNA, 20 bp, Artificial Sequence
  sgRNA
  NTC_1684
ctgatgttgtcgccccgccg

SEQ ID NO: 66432 - DNA, 20 bp, Artificial Sequence
  sgRNA
  NTC_1685
acgggagtacttccacgtta

SEQ ID NO: 66433 - DNA, 20 bp, Artificial Sequence
  sgRNA
  NTC_1686
ttgcatagagggcgaccgcg

SEQ ID NO: 66434 - DNA, 20 bp, Artificial Sequence
  sgRNA
  NTC_1687
ggacttatcatacgcgaacc

SEQ ID NO: 66435 - DNA, 20 bp, Artificial Sequence
  sgRNA
  NTC_1688
aatcgctgataatcctgcgt

SEQ ID NO: 66436 - DNA, 20 bp, Artificial Sequence
  sgRNA
  NTC_1689
cgactttataagcgtcgcgc

SEQ ID NO: 66437 - DNA, 20 bp, Artificial Sequence
  sgRNA
  NTC_1690
ggttgtgattcgtccgttaa

SEQ ID NO: 66438 - DNA, 20 bp, Artificial Sequence
  sgRNA
  NTC_1691
gtcacgtattcgcgctgagt

SEQ ID NO: 66439 - DNA, 20 bp, Artificial Sequence
  sgRNA
  NTC_1692
gggtcatagcaacgccgtcc

SEQ ID NO: 66440 - DNA, 20 bp, Artificial Sequence
  sgRNA
  NTC_1693
agctcttcgacgttatcgat

SEQ ID NO: 66441 - DNA, 20 bp, Artificial Sequence
  sgRNA
  NTC_1694
gcgtatcgaactccgacgag

SEQ ID NO: 66442 - DNA, 20 bp, Artificial Sequence
  sgRNA
  NTC_1695
gggcaaacttcgccgctacg

SEQ ID NO: 66443 - DNA, 20 bp, Artificial Sequence
  sgRNA
  NTC_1696
tcgggctcgcgtatgaccgt

SEQ ID NO: 66444 - DNA, 20 bp, Artificial Sequence
  sgRNA
  NTC_1697
agtcagtgtcggctcgtacg

SEQ ID NO: 66445 - DNA, 20 bp, Artificial Sequence
  sgRNA
  NTC_1698
ctcatcgagcggacgtacaa

SEQ ID NO: 66446 - DNA, 20 bp, Artificial Sequence
  sgRNA
  NTC_1699
gtctatctcgaacgattatc

SEQ ID NO: 66447 - DNA, 20 bp, Artificial Sequence
  sgRNA
  NTC_1700
cgctggcaaagtagcgcgac

SEQ ID NO: 66448 - DNA, 20 bp, Artificial Sequence
  sgRNA
  NTC_1701
gtcgatcaatagcgcgtcat

SEQ ID NO: 66449 - DNA, 20 bp, Artificial Sequence
  sgRNA
  NTC_1702
tttggaatcacgacgacgct

SEQ ID NO: 66450 - DNA, 20 bp, Artificial Sequence
  sgRNA
  NTC_1703
caaaagtgatcgccgcatgt

SEQ ID NO: 66451 - DNA, 20 bp, Artificial Sequence
  sgRNA
  NTC_1704
gaatcgtcgcggctaacgcg

SEQ ID NO: 66452 - DNA, 20 bp, Artificial Sequence
  sgRNA
  NTC_1705
cgcgacggatgaagtcgtgc

SEQ ID NO: 66453 - DNA, 20 bp, Artificial Sequence
  sgRNA
  NTC_1706
tcttcggtgttgaacgcccc

SEQ ID NO: 66454 - DNA, 20 bp, Artificial Sequence
  sgRNA
  NTC_1707
cgcgcaacgaatctacttaa

SEQ ID NO: 66455 - DNA, 20 bp, Artificial Sequence
  sgRNA
  NTC_1708
agaacgatacacgttaacga

SEQ ID NO: 66456 - DNA, 20 bp, Artificial Sequence
  sgRNA
  NTC_1709
gctacattgcacctcgaata

SEQ ID NO: 66457 - DNA, 20 bp, Artificial Sequence
  sgRNA
  NTC_1710
ttggaaacgcgacgaaccct

SEQ ID NO: 66458 - DNA, 20 bp, Artificial Sequence
  sgRNA
  NTC_1711
gggcgttcgtttcgtatgcc

SEQ ID NO: 66459 - DNA, 20 bp, Artificial Sequence
  sgRNA
  NTC_1712
aactgtgtatcgctcgagca

SEQ ID NO: 66460 - DNA, 20 bp, Artificial Sequence
  sgRNA
  NTC_1713
gcggtatagcgacgacttag

SEQ ID NO: 66461 - DNA, 20 bp, Artificial Sequence
  sgRNA
  NTC_1714
cgtctcttcgctaacgcgcc

SEQ ID NO: 66462 - DNA, 20 bp, Artificial Sequence
  sgRNA
  NTC_1715
agttcgcacgcgcaacaagc

SEQ ID NO: 66463 - DNA, 20 bp, Artificial Sequence
  sgRNA
  NTC_1716
cgtcaggcgtcgatcaccga

SEQ ID NO: 66464 - DNA, 20 bp, Artificial Sequence
  sgRNA
  NTC_1717
tatgggtgtcgcgcgcgtca

SEQ ID NO: 66465 - DNA, 20 bp, Artificial Sequence
  sgRNA
  NTC_1718
gtcgctttcggagaccgcga

SEQ ID NO: 66466 - DNA, 20 bp, Artificial Sequence
  sgRNA
  NTC_1719
gagatgtggtcgtcataacc

SEQ ID NO: 66467 - DNA, 20 bp, Artificial Sequence
  sgRNA
  NTC_1720
catgtgcgtcgcgcctccgt

SEQ ID NO: 66468 - DNA, 20 bp, Artificial Sequence
  sgRNA
  NTC_1721
taggttacgcacctcgctat

SEQ ID NO: 66469 - DNA, 20 bp, Artificial Sequence
  sgRNA
  NTC_1722
gggtgaatacagcgcgatct

SEQ ID NO: 66470 - DNA, 20 bp, Artificial Sequence
  sgRNA
  NTC_1723
cgtttggcgcgctattaatt

SEQ ID NO: 66471 - DNA, 20 bp, Artificial Sequence
  sgRNA
  NTC_1724
ggagctatgcaacgtacgat

SEQ ID NO: 66472 - DNA, 20 bp, Artificial Sequence
  sgRNA
  NTC_1725
ctactagaagcgcgtgcgaa

SEQ ID NO: 66473 - DNA, 20 bp, Artificial Sequence
  sgRNA
  NTC_1726
aggtcgattcttgatcgatt

SEQ ID NO: 66474 - DNA, 20 bp, Artificial Sequence
  sgRNA
  NTC_1727
cgttaatcgcatcgttagcg

SEQ ID NO: 66475 - DNA, 20 bp, Artificial Sequence
  sgRNA
  NTC_1728
cgcgtattcgcagtcgattt

SEQ ID NO: 66476 - DNA, 20 bp, Artificial Sequence
  sgRNA
  NTC_1729
cagcatctacgtcgcgtcta

SEQ ID NO: 66477 - DNA, 20 bp, Artificial Sequence
  sgRNA
  NTC_1730
aaggatgcgcgatccgaacg

SEQ ID NO: 66478 - DNA, 20 bp, Artificial Sequence
  sgRNA
  NTC_1731
gcggtagtgcactgtcgatt

SEQ ID NO: 66479 - DNA, 20 bp, Artificial Sequence
  sgRNA
  NTC_1732
caattcgggtctacgtcaat

SEQ ID NO: 66480 - DNA, 20 bp, Artificial Sequence
  sgRNA
  NTC_1733
cgctagctcaatgttcgatc

SEQ ID NO: 66481 - DNA, 20 bp, Artificial Sequence
  sgRNA
  NTC_1734
taacgcgaggatcaccgaac

SEQ ID NO: 66482 - DNA, 20 bp, Artificial Sequence
  sgRNA
  NTC_1735
taggctcaagatacgacgtc

SEQ ID NO: 66483 - DNA, 20 bp, Artificial Sequence
  sgRNA
  NTC_1736
ggtttacgtcaatgcgacat

SEQ ID NO: 66484 - DNA, 20 bp, Artificial Sequence
  sgRNA
  NTC_1737
gacagatgatcattcgaact

SEQ ID NO: 66485 - DNA, 20 bp, Artificial Sequence
  sgRNA
  NTC_1738
gactacgcgcgtccgagatg

SEQ ID NO: 66486 - DNA, 20 bp, Artificial Sequence
  sgRNA
  NTC_1739
cacgtgctactcttcgcaac

SEQ ID NO: 66487 - DNA, 20 bp, Artificial Sequence
  sgRNA
  NTC_1740
aacgtgagacttactcgaat

SEQ ID NO: 66488 - DNA, 20 bp, Artificial Sequence
  sgRNA
  NTC_1741
gcaaagactttcgatcgtgc

SEQ ID NO: 66489 - DNA, 20 bp, Artificial Sequence
  sgRNA
  NTC_1742
gcgcggtgacattaccgttc

SEQ ID NO: 66490 - DNA, 20 bp, Artificial Sequence
  sgRNA
  NTC_1743
aacgactatctcgaacgcgt

SEQ ID NO: 66491 - DNA, 20 bp, Artificial Sequence
  sgRNA
  NTC_1744
gcgcgagggatcatgccgat

SEQ ID NO: 66492 - DNA, 20 bp, Artificial Sequence
  sgRNA
  NTC_1745
gcggagctatgtcgcacata

SEQ ID NO: 66493 - DNA, 20 bp, Artificial Sequence
  sgRNA
  NTC_1746
agttcggcattgcgaaccaa

SEQ ID NO: 66494 - DNA, 20 bp, Artificial Sequence
  sgRNA
  NTC_1747
tgcgacgacggcgcctaacc

SEQ ID NO: 66495 - DNA, 20 bp, Artificial Sequence
  sgRNA
  NTC_1748
atcgactcgttcacgagttc

SEQ ID NO: 66496 - DNA, 20 bp, Artificial Sequence
  sgRNA
  NTC_1749
cgcgaacgaaactgctcgaa

SEQ ID NO: 66497 - DNA, 20 bp, Artificial Sequence
  sgRNA
  NTC_1750
cgtgtcgctcgtaccgctag

SEQ ID NO: 66498 - DNA, 20 bp, Artificial Sequence
  sgRNA
  NTC_1751
gttgcgtcgagccgtatcgc

SEQ ID NO: 66499 - DNA, 20 bp, Artificial Sequence
  sgRNA
  NTC_1752
cttagtcgcgattacgacgt

SEQ ID NO: 66500 - DNA, 20 bp, Artificial Sequence
  sgRNA
  NTC_1753
tgtcatcagcggcgcgtaca

SEQ ID NO: 66501 - DNA, 20 bp, Artificial Sequence
  sgRNA
  NTC_1754
tcttcgcgagcgcataacgc

SEQ ID NO: 66502 - DNA, 20 bp, Artificial Sequence
  sgRNA
  NTC_1755
tgcgacggtcatctcgcgta

SEQ ID NO: 66503 - DNA, 20 bp, Artificial Sequence
  sgRNA
  NTC_1756
gtacgacattcgccgccgtt

SEQ ID NO: 66504 - DNA, 20 bp, Artificial Sequence
  sgRNA
  NTC_1757
gatagatgtcggccgatccg

SEQ ID NO: 66505 - DNA, 20 bp, Artificial Sequence
  sgRNA
  NTC_1758
tcgcaacgggttgcatgtcc

SEQ ID NO: 66506 - DNA, 20 bp, Artificial Sequence
  sgRNA
  NTC_1759
ctgagatagtcgaaccccgc

SEQ ID NO: 66507 - DNA, 20 bp, Artificial Sequence
  sgRNA
  NTC_1760
tcgtcggggctaatgtcgcc

SEQ ID NO: 66508 - DNA, 20 bp, Artificial Sequence
  sgRNA
  NTC_1761
aacgaagatcactacgtatg

SEQ ID NO: 66509 - DNA, 20 bp, Artificial Sequence
  sgRNA
  NTC_1762
gttaagtacacgtacgcaag

SEQ ID NO: 66510 - DNA, 20 bp, Artificial Sequence
  sgRNA
  NTC_1763
cggtcggattcgttaatagt

SEQ ID NO: 66511 - DNA, 20 bp, Artificial Sequence
  sgRNA
  NTC_1764
cttgataactcgattgcgcg

SEQ ID NO: 66512 - DNA, 20 bp, Artificial Sequence
  sgRNA
  NTC_1765
cacgcgatcgtgcgagcaac

SEQ ID NO: 66513 - DNA, 20 bp, Artificial Sequence
  sgRNA
  NTC_1766
agtagttcggcgtatcgagt

SEQ ID NO: 66514 - DNA, 20 bp, Artificial Sequence
  sgRNA
  NTC_1767
acgaaagcgcggcgtcagct

SEQ ID NO: 66515 - DNA, 20 bp, Artificial Sequence
  sgRNA
  NTC_1768
gcgtagtgcaaccacttata

SEQ ID NO: 66516 - DNA, 20 bp, Artificial Sequence
  sgRNA
  NTC_1769
aggaggacgttccgattgcg

SEQ ID NO: 66517 - DNA, 20 bp, Artificial Sequence
  sgRNA
  NTC_1770
tagtcggtacgcccgatgag

SEQ ID NO: 66518 - DNA, 20 bp, Artificial Sequence
  sgRNA
  NTC_1771
gtagtttgcgtaagcgatct

SEQ ID NO: 66519 - DNA, 20 bp, Artificial Sequence
  sgRNA
  NTC_1772
ttcgcgtcgtacgagtaact

SEQ ID NO: 66520 - DNA, 20 bp, Artificial Sequence
  sgRNA
  NTC_1773
gcatcataattgaacgcgcg

SEQ ID NO: 66521 - DNA, 20 bp, Artificial Sequence
  sgRNA
  NTC_1774
gaaagcgcgcgccctattgc

SEQ ID NO: 66522 - DNA, 20 bp, Artificial Sequence
  sgRNA
  NTC_1775
cgtaagtgacacgatcgtta

SEQ ID NO: 66523 - DNA, 20 bp, Artificial Sequence
  sgRNA
  NTC_1776
cgacgatcaggagccgtcga

SEQ ID NO: 66524 - DNA, 20 bp, Artificial Sequence
  sgRNA
  NTC_1777
atcgagattaacgtacaccc

SEQ ID NO: 66525 - DNA, 20 bp, Artificial Sequence
  sgRNA
  NTC_1778
acgtaatcttcataacccgt

SEQ ID NO: 66526 - DNA, 20 bp, Artificial Sequence
  sgRNA
  NTC_1779
agcatggcatacgtcgcgtc

SEQ ID NO: 66527 - DNA, 20 bp, Artificial Sequence
  sgRNA
  NTC_1780
tcagtcgggttcaacgcgtt

SEQ ID NO: 66528 - DNA, 20 bp, Artificial Sequence
  sgRNA
  NTC_1781
ggatcgcaattcgaccacgt

SEQ ID NO: 66529 - DNA, 20 bp, Artificial Sequence
  sgRNA
  NTC_1782
tttgcactcatcgccgatga

SEQ ID NO: 66530 - DNA, 20 bp, Artificial Sequence
  sgRNA
  NTC_1783
gtggcagcgacgatgatcgt

SEQ ID NO: 66531 - DNA, 20 bp, Artificial Sequence
  sgRNA
  NTC_1784
aacgatcgagcgtccattcg

SEQ ID NO: 66532 - DNA, 20 bp, Artificial Sequence
  sgRNA
  NTC_1785
acaacgcgcatacgctcaat

SEQ ID NO: 66533 - DNA, 20 bp, Artificial Sequence
  sgRNA
  NTC_1786
gcggttcgtcgtgagaacta

SEQ ID NO: 66534 - DNA, 20 bp, Artificial Sequence
  sgRNA
  NTC_1787
cgacgctgtaaccgaccgaa

SEQ ID NO: 66535 - DNA, 20 bp, Artificial Sequence
  sgRNA
  NTC_1788
gcgtggagagtatcgtcaac

SEQ ID NO: 66536 - DNA, 20 bp, Artificial Sequence
  sgRNA
  NTC_1789
acagtaacgcggtcgttctg

SEQ ID NO: 66537 - DNA, 20 bp, Artificial Sequence
  sgRNA
  NTC_1790
tacgctggtacgcctacgac

SEQ ID NO: 66538 - DNA, 20 bp, Artificial Sequence
  sgRNA
  NTC_1791
gattcggtacttgacgtgtc

SEQ ID NO: 66539 - DNA, 20 bp, Artificial Sequence
  sgRNA
  NTC_1792
ctatcgcaatagcgcatacg

SEQ ID NO: 66540 - DNA, 20 bp, Artificial Sequence
  sgRNA
  NTC_1793
cgcggatcgatagtgtatta

SEQ ID NO: 66541 - DNA, 20 bp, Artificial Sequence
  sgRNA
  NTC_1794
cgttaatggcggagtaacgt

SEQ ID NO: 66542 - DNA, 20 bp, Artificial Sequence
  sgRNA
  NTC_1795
tgcgtaagttcgtaagcatc

SEQ ID NO: 66543 - DNA, 20 bp, Artificial Sequence
  sgRNA
  NTC_1796
gcatcgacgttacagtcgtg

SEQ ID NO: 66544 - DNA, 20 bp, Artificial Sequence
  sgRNA
  NTC_1797
gagtacggtgatcccataat

SEQ ID NO: 66545 - DNA, 20 bp, Artificial Sequence
  sgRNA
  NTC_1798
atgagttggcagcgcgtaat

SEQ ID NO: 66546 - DNA, 20 bp, Artificial Sequence
  sgRNA
  NTC_1799
ctatcggtcgacgattcgag

SEQ ID NO: 66547 - DNA, 20 bp, Artificial Sequence
  sgRNA
  NTC_1800
agaaactggatcgttcgcgt

SEQ ID NO: 66548 - DNA, 20 bp, Artificial Sequence
  sgRNA
  NTC_1801
tcttgagcttcacgagcgcg

SEQ ID NO: 66549 - DNA, 20 bp, Artificial Sequence
  sgRNA
  NTC_1802
actaggatggcgccgcgcat

SEQ ID NO: 66550 - DNA, 20 bp, Artificial Sequence
  sgRNA
  NTC_1803
agcgcgcagtcacctagacg

SEQ ID NO: 66551 - DNA, 20 bp, Artificial Sequence
  sgRNA
  NTC_1804
cacggaatgactactctcgc

SEQ ID NO: 66552 - DNA, 20 bp, Artificial Sequence
  sgRNA
  NTC_1805
gacgatcgcgtagctgtcta

SEQ ID NO: 66553 - DNA, 20 bp, Artificial Sequence
  sgRNA
  NTC_1806
cgcgaattgtgcgccgaaga

SEQ ID NO: 66554 - DNA, 20 bp, Artificial Sequence
  sgRNA
  NTC_1807
tagcgtgcatagaacgcgac

SEQ ID NO: 66555 - DNA, 20 bp, Artificial Sequence
  sgRNA
  NTC_1808
cgttatgcaattcgacgtct

SEQ ID NO: 66556 - DNA, 20 bp, Artificial Sequence
  sgRNA
  NTC_1809
gatagcacgatccgccaatt

SEQ ID NO: 66557 - DNA, 20 bp, Artificial Sequence
  sgRNA
  NTC_1810
tcggcacattattacgagac

SEQ ID NO: 66558 - DNA, 20 bp, Artificial Sequence
  sgRNA
  NTC_1811
cagtcgtacgcgataactgt

SEQ ID NO: 66559 - DNA, 20 bp, Artificial Sequence
  sgRNA
  NTC_1812
tattctgacgggtcgcgttt

SEQ ID NO: 66560 - DNA, 20 bp, Artificial Sequence
  sgRNA
  NTC_1813
gcggcggtacgcctaaatac

SEQ ID NO: 66561 - DNA, 20 bp, Artificial Sequence
  sgRNA
  NTC_1814
tgcgatgctgctaaaatcgc

SEQ ID NO: 66562 - DNA, 20 bp, Artificial Sequence
  sgRNA
  NTC_1815
acgcgtttagcacgtatgtt

SEQ ID NO: 66563 - DNA, 20 bp, Artificial Sequence
  sgRNA
  NTC_1816
caacgaaatggcgtgtacgc

SEQ ID NO: 66564 - DNA, 20 bp, Artificial Sequence
  sgRNA
  NTC_1817
gacttgagtcgtccgttgcg

SEQ ID NO: 66565 - DNA, 20 bp, Artificial Sequence
  sgRNA
  NTC_1818
tcttcagtaaacgtaccgtc

SEQ ID NO: 66566 - DNA, 20 bp, Artificial Sequence
  sgRNA
  NTC_1819
acgagtttcgcagtcgcctt

SEQ ID NO: 66567 - DNA, 20 bp, Artificial Sequence
  sgRNA
  NTC_1820
gaacgcgcgcgaatcgctat

SEQ ID NO: 66568 - DNA, 20 bp, Artificial Sequence
  sgRNA
  NTC_1821
actacggcggcgttactcgt

SEQ ID NO: 66569 - DNA, 20 bp, Artificial Sequence
  sgRNA
  NTC_1822
attcttacggagtgcgcagc

SEQ ID NO: 66570 - DNA, 20 bp, Artificial Sequence
  sgRNA
  NTC_1823
acatgggtcgaaccgttaac

SEQ ID NO: 66571 - DNA, 20 bp, Artificial Sequence
  sgRNA
  NTC_1824
gacttcgattagtacgctgt

SEQ ID NO: 66572 - DNA, 20 bp, Artificial Sequence
  sgRNA
  NTC_1825
gatacgaattacgtcatgta

SEQ ID NO: 66573 - DNA, 20 bp, Artificial Sequence
  sgRNA
  NTC_1826
cgtagtaatatgcccgcgcc

SEQ ID NO: 66574 - DNA, 20 bp, Artificial Sequence
  sgRNA
  NTC_1827
aataggcatcgcgtccgaga

SEQ ID NO: 66575 - DNA, 20 bp, Artificial Sequence
  sgRNA
  NTC_1828
agtgcgtcaatcccgtccaa

SEQ ID NO: 66576 - DNA, 20 bp, Artificial Sequence
  sgRNA
  NTC_1829
ctaagtgcgtgctcgaattc

SEQ ID NO: 66577 - DNA, 20 bp, Artificial Sequence
  sgRNA
  NTC_1830
tctttctacgagcgcgccgt

SEQ ID NO: 66578 - DNA, 20 bp, Artificial Sequence
  sgRNA
  NTC_1831
catacactgcggctcgtatg

SEQ ID NO: 66579 - DNA, 20 bp, Artificial Sequence
  sgRNA
  NTC_1832
tcgcatcggactagccgttc

SEQ ID NO: 66580 - DNA, 20 bp, Artificial Sequence
  sgRNA
  NTC_1833
gatttatcgacgcgttgcga

SEQ ID NO: 66581 - DNA, 20 bp, Artificial Sequence
  sgRNA
  NTC_1834
tatttgactggccgcgtccg

SEQ ID NO: 66582 - DNA, 20 bp, Artificial Sequence
  sgRNA
  NTC_1835
cgctttcgcaatgcgcgata

SEQ ID NO: 66583 - DNA, 20 bp, Artificial Sequence
  sgRNA
  NTC_1836
cttgcgatatgttgtcgcgc

SEQ ID NO: 66584 - DNA, 20 bp, Artificial Sequence
  sgRNA
  NTC_1837
atacattattcgcgcgaatg

SEQ ID NO: 66585 - DNA, 20 bp, Artificial Sequence
  sgRNA
  NTC_1838
ctcgcgggaaataagtcgat

SEQ ID NO: 66586 - DNA, 20 bp, Artificial Sequence
  sgRNA
  NTC_1839
tcgacagggggcagtcgtta

SEQ ID NO: 66587 - DNA, 20 bp, Artificial Sequence
  sgRNA
  NTC_1840
gtcgttgtagcacccattcg

SEQ ID NO: 66588 - DNA, 20 bp, Artificial Sequence
  sgRNA
  NTC_1841
ggacgcagtacgtgcgctaa

SEQ ID NO: 66589 - DNA, 20 bp, Artificial Sequence
  sgRNA
  NTC_1842
cgcggctcggtagacgatat

SEQ ID NO: 66590 - DNA, 20 bp, Artificial Sequence
  sgRNA
  NTC_1843
ctgttcggtcataccgaatc

SEQ ID NO: 66591 - DNA, 20 bp, Artificial Sequence
  sgRNA
  NTC_1844
gatattcatgacaccgaacg

SEQ ID NO: 66592 - DNA, 20 bp, Artificial Sequence
  sgRNA
  NTC_1845
gcggttgcttgtaacgcgtc

SEQ ID NO: 66593 - DNA, 20 bp, Artificial Sequence
  sgRNA
  NTC_1846
cgatcggggatcttcgcgac

SEQ ID NO: 66594 - DNA, 20 bp, Artificial Sequence
  sgRNA
  NTC_1847
ctcaatacgcgtcccgaatc

SEQ ID NO: 66595 - DNA, 20 bp, Artificial Sequence
  sgRNA
  NTC_1848
tgcaggtacgcgtgccaatt

SEQ ID NO: 66596 - DNA, 20 bp, Artificial Sequence
  sgRNA
  NTC_1849
gcgctcactcgaccaagcga

SEQ ID NO: 66597 - DNA, 20 bp, Artificial Sequence
  sgRNA
  NTC_1850
ggagcggtattcacgcgcgt

SEQ ID NO: 66598 - DNA, 20 bp, Artificial Sequence
  sgRNA
  NTC_1851
gaatactcagacgtaaccgt

SEQ ID NO: 66599 - DNA, 20 bp, Artificial Sequence
  sgRNA
  NTC_1852
ctaatagcggctgccgatcg

SEQ ID NO: 66600 - DNA, 20 bp, Artificial Sequence
  sgRNA
  NTC_1853
tggagaataacacgcgtata

SEQ ID NO: 66601 - DNA, 20 bp, Artificial Sequence
  sgRNA
  NTC_1854
tggcgaaactctagcgatcc

SEQ ID NO: 66602 - DNA, 20 bp, Artificial Sequence
  sgRNA
  NTC_1855
tctctatttcatgccgacga

SEQ ID NO: 66603 - DNA, 20 bp, Artificial Sequence
  sgRNA
  NTC_1856
ggggttgctcgtatcgagtt

SEQ ID NO: 66604 - DNA, 20 bp, Artificial Sequence
  sgRNA
  NTC_1857
aatatgaacgtgtcgatcgt

SEQ ID NO: 66605 - DNA, 20 bp, Artificial Sequence
  sgRNA
  NTC_1858
ttgcgcagctgaagcgatac

SEQ ID NO: 66606 - DNA, 20 bp, Artificial Sequence
  sgRNA
  NTC_1859
tagcaagcgcggcccgttac

SEQ ID NO: 66607 - DNA, 20 bp, Artificial Sequence
  sgRNA
  NTC_1860
gcaaaaggatatcgcgttaa

SEQ ID NO: 66608 - DNA, 20 bp, Artificial Sequence
  sgRNA
  NTC_1861
gtacgctaacggatcaaata

SEQ ID NO: 66609 - DNA, 20 bp, Artificial Sequence
  sgRNA
  NTC_1862
tgctgatcgtactccgcgaa

SEQ ID NO: 66610 - DNA, 20 bp, Artificial Sequence
  sgRNA
  NTC_1863
cggctaactgcgcgcgtact

SEQ ID NO: 66611 - DNA, 20 bp, Artificial Sequence
  sgRNA
  NTC_1864
catacgtatggcgcccgact

SEQ ID NO: 66612 - DNA, 20 bp, Artificial Sequence
  sgRNA
  NTC_1865
cgttagctctaatgcccgag

SEQ ID NO: 66613 - DNA, 20 bp, Artificial Sequence
  sgRNA
  NTC_1866
cgtacgcaagtgacgaaact

SEQ ID NO: 66614 - DNA, 20 bp, Artificial Sequence
  sgRNA
  NTC_1867
tcgtcaagtaacgccaattg

SEQ ID NO: 66615 - DNA, 20 bp, Artificial Sequence
  sgRNA
  NTC_1868
gaatgacggtcgtcctatat

SEQ ID NO: 66616 - DNA, 20 bp, Artificial Sequence
  sgRNA
  NTC_1869
gcgattaagtatcgaccgca

SEQ ID NO: 66617 - DNA, 20 bp, Artificial Sequence
  sgRNA
  NTC_1870
ctttgcacgcggtgcgacgt

SEQ ID NO: 66618 - DNA, 20 bp, Artificial Sequence
  sgRNA
  NTC_1871
actatcgtaggtgcgttcaa

SEQ ID NO: 66619 - DNA, 20 bp, Artificial Sequence
  sgRNA
  NTC_1872
gatacgcaaagaatcacgct

SEQ ID NO: 66620 - DNA, 20 bp, Artificial Sequence
  sgRNA
  NTC_1873
gaagtactcgtcgcgaaact

SEQ ID NO: 66621 - DNA, 20 bp, Artificial Sequence
  sgRNA
  NTC_1874
tagcggcgggcaaccgcctt

SEQ ID NO: 66622 - DNA, 20 bp, Artificial Sequence
  sgRNA
  NTC_1875
gtggtaacgtcgactcagta

SEQ ID NO: 66623 - DNA, 20 bp, Artificial Sequence
  sgRNA
  NTC_1876
cactcgcggaaaacgatcgc

SEQ ID NO: 66624 - DNA, 20 bp, Artificial Sequence
  sgRNA
  NTC_1877
ggtaacatgtggcgccagca

SEQ ID NO: 66625 - DNA, 20 bp, Artificial Sequence
  sgRNA
  NTC_1878
aatgcgaatacgatctccgc

SEQ ID NO: 66626 - DNA, 20 bp, Artificial Sequence
  sgRNA
  NTC_1879
ttggtaaagtcgcgattacc

SEQ ID NO: 66627 - DNA, 20 bp, Artificial Sequence
  sgRNA
  NTC_1880
tcttgggcgtgatataacgt

SEQ ID NO: 66628 - DNA, 20 bp, Artificial Sequence
  sgRNA
  NTC_1881
atggctcgcgggtcacgacg

SEQ ID NO: 66629 - DNA, 20 bp, Artificial Sequence
  sgRNA
  NTC_1882
aggaaacgtgcgacgttcat

SEQ ID NO: 66630 - DNA, 20 bp, Artificial Sequence
  sgRNA
  NTC_1883
attggtctagtactcgcgac

SEQ ID NO: 66631 - DNA, 20 bp, Artificial Sequence
  sgRNA
  NTC_1884
ggcggatactggatcccgac

SEQ ID NO: 66632 - DNA, 20 bp, Artificial Sequence
  sgRNA
  NTC_1885
ttgctcggttcgccgaacgt

SEQ ID NO: 66633 - DNA, 20 bp, Artificial Sequence
  sgRNA
  NTC_1886
gcggacttaatccgcaccga

SEQ ID NO: 66634 - DNA, 20 bp, Artificial Sequence
  sgRNA
  NTC_1887
aatagtaagatccctacgag

SEQ ID NO: 66635 - DNA, 20 bp, Artificial Sequence
  sgRNA
  NTC_1888
gacttgtgcagcattgcgcg

SEQ ID NO: 66636 - DNA, 20 bp, Artificial Sequence
  sgRNA
  NTC_1889
agcagctgaacgaccgaccc

SEQ ID NO: 66637 - DNA, 20 bp, Artificial Sequence
  sgRNA
  NTC_1890
gaggcggatcgatcgcgctt

SEQ ID NO: 66638 - DNA, 20 bp, Artificial Sequence
  sgRNA
  NTC_1891
ggcaaggtgaataccgcgac

SEQ ID NO: 66639 - DNA, 20 bp, Artificial Sequence
  sgRNA
  NTC_1892
gtatacgactctgccccgcg

SEQ ID NO: 66640 - DNA, 20 bp, Artificial Sequence
  sgRNA
  NTC_1893
tgcttcggtactgcgacgta

SEQ ID NO: 66641 - DNA, 20 bp, Artificial Sequence
  sgRNA
  NTC_1894
cggcactaggcgaatcgccc

SEQ ID NO: 66642 - DNA, 20 bp, Artificial Sequence
  sgRNA
  NTC_1895
gtcgctatcagtcgcgaatt

SEQ ID NO: 66643 - DNA, 20 bp, Artificial Sequence
  sgRNA
  NTC_1896
cgacgcgcttgcgaccgctg

SEQ ID NO: 66644 - DNA, 20 bp, Artificial Sequence
  sgRNA
  NTC_1897
caagcgctacatcccgaatc

SEQ ID NO: 66645 - DNA, 20 bp, Artificial Sequence
  sgRNA
  NTC_1898
gctagtaaatacgctagcgt

SEQ ID NO: 66646 - DNA, 20 bp, Artificial Sequence
  sgRNA
  NTC_1899
caacgcacgcgtcccagatt

SEQ ID NO: 66647 - DNA, 20 bp, Artificial Sequence
  sgRNA
  NTC_1900
tgcacgtttcatcgctcgac

SEQ ID NO: 66648 - DNA, 20 bp, Artificial Sequence
  sgRNA
  NTC_1901
acattctatcggccgcgacc

SEQ ID NO: 66649 - DNA, 20 bp, Artificial Sequence
  sgRNA
  NTC_1902
atggcgggttgccgtagagt

SEQ ID NO: 66650 - DNA, 20 bp, Artificial Sequence
  sgRNA
  NTC_1903
tacaggcggtacgctcgatg

SEQ ID NO: 66651 - DNA, 20 bp, Artificial Sequence
  sgRNA
  NTC_1904
cgctaacgttgtacgaacat

SEQ ID NO: 66652 - DNA, 20 bp, Artificial Sequence
  sgRNA
  NTC_1905
ggcgcgactaaaaccgttgt

SEQ ID NO: 66653 - DNA, 20 bp, Artificial Sequence
  sgRNA
  NTC_1906
cgataaaggctgcgtccgct

SEQ ID NO: 66654 - DNA, 20 bp, Artificial Sequence
  sgRNA
  NTC_1907
cgaatatgacgcacgcgcgt

SEQ ID NO: 66655 - DNA, 20 bp, Artificial Sequence
  sgRNA
  NTC_1908
ttcgaagtcgtcgacaccat

SEQ ID NO: 66656 - DNA, 20 bp, Artificial Sequence
  sgRNA
  NTC_1909
cactgcgcgtacctcgagta

SEQ ID NO: 66657 - DNA, 20 bp, Artificial Sequence
  sgRNA
  NTC_1910
agctacgtagctatacgacc

SEQ ID NO: 66658 - DNA, 20 bp, Artificial Sequence
  sgRNA
  NTC_1911
ttagggcactcgcgacgacc

SEQ ID NO: 66659 - DNA, 20 bp, Artificial Sequence
  sgRNA
  NTC_1912
attagaaaatcgcgatctca

SEQ ID NO: 66660 - DNA, 20 bp, Artificial Sequence
  sgRNA
  NTC_1913
agtttgacgcgctgatcgca

SEQ ID NO: 66661 - DNA, 20 bp, Artificial Sequence
  sgRNA
  NTC_1914
gtcagaacagtgttcgcgca

SEQ ID NO: 66662 - DNA, 20 bp, Artificial Sequence
  sgRNA
  NTC_1915
acgacggacgtgtccgagtt

SEQ ID NO: 66663 - DNA, 20 bp, Artificial Sequence
  sgRNA
  NTC_1916
ctcgcttaggcacgcctact

SEQ ID NO: 66664 - DNA, 20 bp, Artificial Sequence
  sgRNA
  NTC_1917
aggcgtacgacgaaattaat

SEQ ID NO: 66665 - DNA, 20 bp, Artificial Sequence
  sgRNA
  NTC_1918
cggcgtctatgcgacgtatc

SEQ ID NO: 66666 - DNA, 20 bp, Artificial Sequence
  sgRNA
  NTC_1919
tactttacggggcgtcgact

SEQ ID NO: 66667 - DNA, 20 bp, Artificial Sequence
  sgRNA
  NTC_1920
atatttgagtcgcgcgaatc

SEQ ID NO: 66668 - DNA, 20 bp, Artificial Sequence
  sgRNA
  NTC_1921
cgtgggcgacaatccacacc

SEQ ID NO: 66669 - DNA, 20 bp, Artificial Sequence
  sgRNA
  NTC_1922
gtaacagcgtagcgacctaa

SEQ ID NO: 66670 - DNA, 20 bp, Artificial Sequence
  sgRNA
  NTC_1923
tgcacagtcgcattgcgtcg

SEQ ID NO: 66671 - DNA, 20 bp, Artificial Sequence
  sgRNA
  NTC_1924
acgagttacgcaacgttgcg

SEQ ID NO: 66672 - DNA, 20 bp, Artificial Sequence
  sgRNA
  NTC_1925
tcatacgctacttcgacgta

SEQ ID NO: 66673 - DNA, 20 bp, Artificial Sequence
  sgRNA
  NTC_1926
atcttgaggtcgcgcgcgaa

SEQ ID NO: 66674 - DNA, 20 bp, Artificial Sequence
  sgRNA
  NTC_1927
tgcgacgcgtatcatgcagc

SEQ ID NO: 66675 - DNA, 20 bp, Artificial Sequence
  sgRNA
  NTC_1928
agatcggtcgactccgtcat

SEQ ID NO: 66676 - DNA, 20 bp, Artificial Sequence
  sgRNA
  NTC_1929
gcgcgatcgtctgaacctcg

SEQ ID NO: 66677 - DNA, 20 bp, Artificial Sequence
  sgRNA
  NTC_1930
gatcgacaaaagtctcgatc

SEQ ID NO: 66678 - DNA, 20 bp, Artificial Sequence
  sgRNA
  NTC_1931
tactctggggcgaacgtgtc

SEQ ID NO: 66679 - DNA, 20 bp, Artificial Sequence
  sgRNA
  NTC_1932
ctggacgatattccgcgacg

SEQ ID NO: 66680 - DNA, 20 bp, Artificial Sequence
  sgRNA
  NTC_1933
ttgcggcgtagcgcgtttct

SEQ ID NO: 66681 - DNA, 20 bp, Artificial Sequence
  sgRNA
  NTC_1934
cgcaaatacgggtcgcgctg

SEQ ID NO: 66682 - DNA, 20 bp, Artificial Sequence
  sgRNA
  NTC_1935
tggtcgggacatccgtccgt

SEQ ID NO: 66683 - DNA, 20 bp, Artificial Sequence
  sgRNA
  NTC_1936
aggtagtataggtcgactac

SEQ ID NO: 66684 - DNA, 20 bp, Artificial Sequence
  sgRNA
  NTC_1937
cgcgcagggatatacccagt

SEQ ID NO: 66685 - DNA, 20 bp, Artificial Sequence
  sgRNA
  NTC_1938
gcggctactttcgcacgatc

SEQ ID NO: 66686 - DNA, 20 bp, Artificial Sequence
  sgRNA
  NTC_1939
agttgtcgcgagtctacctc

SEQ ID NO: 66687 - DNA, 20 bp, Artificial Sequence
  sgRNA
  NTC_1940
tcagacgttcgcgaaccgaa

SEQ ID NO: 66688 - DNA, 20 bp, Artificial Sequence
  sgRNA
  NTC_1941
gatcgtggcgcgattattgc

SEQ ID NO: 66689 - DNA, 20 bp, Artificial Sequence
  sgRNA
  NTC_1942
ttaacggtcgtatcgccgtc

SEQ ID NO: 66690 - DNA, 20 bp, Artificial Sequence
  sgRNA
  NTC_1943
ttcgcggctgatatacgact

SEQ ID NO: 66691 - DNA, 20 bp, Artificial Sequence
  sgRNA
  NTC_1944
gcgacacgttaacgccaaag

SEQ ID NO: 66692 - DNA, 20 bp, Artificial Sequence
  sgRNA
  NTC_1945
ttgatcgagatgcgccccga

SEQ ID NO: 66693 - DNA, 20 bp, Artificial Sequence
  sgRNA
  NTC_1946
ttacgggcgtaacacgagta

SEQ ID NO: 66694 - DNA, 20 bp, Artificial Sequence
  sgRNA
  NTC_1947
aggggcgcaagcgtcccgtt

SEQ ID NO: 66695 - DNA, 20 bp, Artificial Sequence
  sgRNA
  NTC_1948
tttcggggtgcgcgctagac

SEQ ID NO: 66696 - DNA, 20 bp, Artificial Sequence
  sgRNA
  NTC_1949
cgcgagatcgacgtacatcc

SEQ ID NO: 66697 - DNA, 20 bp, Artificial Sequence
  sgRNA
  NTC_1950
agtgaaggcgcgtacgatcg

SEQ ID NO: 66698 - DNA, 20 bp, Artificial Sequence
  sgRNA
  NTC_1951
cgaacggcgtcgttatccgt

SEQ ID NO: 66699 - DNA, 20 bp, Artificial Sequence
  sgRNA
  NTC_1952
gtgcggcgaggccgtgcaac

SEQ ID NO: 66700 - DNA, 20 bp, Artificial Sequence
  sgRNA
  NTC_1953
ttcgtatcgaacgcctgcgt

SEQ ID NO: 66701 - DNA, 20 bp, Artificial Sequence
  sgRNA
  NTC_1954
cggtgatagtgacgactcga

SEQ ID NO: 66702 - DNA, 20 bp, Artificial Sequence
  sgRNA
  NTC_1955
acgaagcgaatccgcgcgaa

SEQ ID NO: 66703 - DNA, 20 bp, Artificial Sequence
  sgRNA
  NTC_1956
tggcgactcgcgacattaag

SEQ ID NO: 66704 - DNA, 20 bp, Artificial Sequence
  sgRNA
  NTC_1957
gacgtttcatggcgaacgta

SEQ ID NO: 66705 - DNA, 20 bp, Artificial Sequence
  sgRNA
  NTC_1958
gacgcatttgctctaaaccg

SEQ ID NO: 66706 - DNA, 20 bp, Artificial Sequence
  sgRNA
  NTC_1959
gttactcgggtcgcgtaccg

SEQ ID NO: 66707 - DNA, 20 bp, Artificial Sequence
  sgRNA
  NTC_1960
gagaataagcggcccgcgag

SEQ ID NO: 66708 - DNA, 20 bp, Artificial Sequence
  sgRNA
  NTC_1961
ttgttcgagatacgttgacg

SEQ ID NO: 66709 - DNA, 20 bp, Artificial Sequence
  sgRNA
  NTC_1962
ggttgatagcggtaatcgac

SEQ ID NO: 66710 - DNA, 20 bp, Artificial Sequence
  sgRNA
  NTC_1963
ggtacaatcgatcccgtata

SEQ ID NO: 66711 - DNA, 20 bp, Artificial Sequence
  sgRNA
  NTC_1964
ctctggtttaaaagcgacga

SEQ ID NO: 66712 - DNA, 20 bp, Artificial Sequence
  sgRNA
  NTC_1965
ggtactgaagcgttcgagcg

SEQ ID NO: 66713 - DNA, 20 bp, Artificial Sequence
  sgRNA
  NTC_1966
tatgcgggtatagtcgaccg

SEQ ID NO: 66714 - DNA, 20 bp, Artificial Sequence
  sgRNA
  NTC_1967
gttacggcggcacgacacag

SEQ ID NO: 66715 - DNA, 20 bp, Artificial Sequence
  sgRNA
  NTC_1968
cggcgtagttagacacgttt

SEQ ID NO: 66716 - DNA, 20 bp, Artificial Sequence
  sgRNA
  NTC_1969
tcgtcgcacactttcgtgcg

SEQ ID NO: 66717 - DNA, 20 bp, Artificial Sequence
  sgRNA
  NTC_1970
ttcacacgacgcgcgagagt

SEQ ID NO: 66718 - DNA, 20 bp, Artificial Sequence
  sgRNA
  NTC_1971
gtcggttggacgcttattcg

SEQ ID NO: 66719 - DNA, 20 bp, Artificial Sequence
  sgRNA
  NTC_1972
atcatcgattcgagcgcctg

SEQ ID NO: 66720 - DNA, 20 bp, Artificial Sequence
  sgRNA
  NTC_1973
gggtaattgattcgtccacc

SEQ ID NO: 66721 - DNA, 20 bp, Artificial Sequence
  sgRNA
  NTC_1974
cgtaatcagtcgcgctgctc

SEQ ID NO: 66722 - DNA, 20 bp, Artificial Sequence
  sgRNA
  NTC_1975
cgtcgatgtatgatcgtaca

SEQ ID NO: 66723 - DNA, 20 bp, Artificial Sequence
  sgRNA
  NTC_1976
tcgtcgcattcttacgacat

SEQ ID NO: 66724 - DNA, 20 bp, Artificial Sequence
  sgRNA
  NTC_1977
ttgtaatagtttcgcgtacc

SEQ ID NO: 66725 - DNA, 20 bp, Artificial Sequence
  sgRNA
  NTC_1978
tggcggtgtaatgcgtctaa

SEQ ID NO: 66726 - DNA, 20 bp, Artificial Sequence
  sgRNA
  NTC_1979
gtatcgcgtgcgaaagtatg

SEQ ID NO: 66727 - DNA, 20 bp, Artificial Sequence
  sgRNA
  NTC_1980
tggtggagctactccgcata

SEQ ID NO: 66728 - DNA, 20 bp, Artificial Sequence
  sgRNA
  NTC_1981
gtcggcgctacgtcgtatag

SEQ ID NO: 66729 - DNA, 20 bp, Artificial Sequence
  sgRNA
  NTC_1982
tgtttcgtgtaccctacgcg

SEQ ID NO: 66730 - DNA, 20 bp, Artificial Sequence
  sgRNA
  NTC_1983
cttcgacgggtcgatacgat

SEQ ID NO: 66731 - DNA, 20 bp, Artificial Sequence
  sgRNA
  NTC_1984
gttacatacgttgcgtaacg

SEQ ID NO: 66732 - DNA, 20 bp, Artificial Sequence
  sgRNA
  NTC_1985
cggacgtacgcgtaataccc

SEQ ID NO: 66733 - DNA, 20 bp, Artificial Sequence
  sgRNA
  NTC_1986
acgctgaactcgcgatgcgt

SEQ ID NO: 66734 - DNA, 20 bp, Artificial Sequence
  sgRNA
  NTC_1987
atgatcgtcgacgagactat

SEQ ID NO: 66735 - DNA, 20 bp, Artificial Sequence
  sgRNA
  NTC_1988
tattcacacgcgcccctatt

SEQ ID NO: 66736 - DNA, 20 bp, Artificial Sequence
  sgRNA
  NTC_1989
ggcgcgtctcgagtcgtgct

SEQ ID NO: 66737 - DNA, 20 bp, Artificial Sequence
  sgRNA
  NTC_1990
cgttgacgtattccgtattg

SEQ ID NO: 66738 - DNA, 20 bp, Artificial Sequence
  sgRNA
  NTC_1991
tggaggtacaattacgcgat

SEQ ID NO: 66739 - DNA, 20 bp, Artificial Sequence
  sgRNA
  NTC_1992
tatcggtcgaacattcgatc

SEQ ID NO: 66740 - DNA, 20 bp, Artificial Sequence
  sgRNA
  NTC_1993
tctcgcgtgcaatccgtact

SEQ ID NO: 66741 - DNA, 20 bp, Artificial Sequence
  sgRNA
  NTC_1994
agtttcggctacctatcgcg

SEQ ID NO: 66742 - DNA, 20 bp, Artificial Sequence
  sgRNA
  NTC_1995
atgtaattcgggtcaacgcg

SEQ ID NO: 66743 - DNA, 20 bp, Artificial Sequence
  sgRNA
  NTC_1996
gcgctctcgacgctcaccac

SEQ ID NO: 66744 - DNA, 20 bp, Artificial Sequence
  sgRNA
  NTC_1997
cttatacaagcagcgtgccg

SEQ ID NO: 66745 - DNA, 20 bp, Artificial Sequence
  sgRNA
  NTC_1998
tatgtgttggtcgcgcagat

SEQ ID NO: 66746 - DNA, 20 bp, Artificial Sequence
  sgRNA
  NTC_1999
gacaattcaatcgatccgtg

SEQ ID NO: 66747 - DNA, 20 bp, Artificial Sequence
  sgRNA
  NTC_2000
ttatcgcgcgagacaagcga

SEQ ID NO: 66748 - DNA, 20 bp, Artificial Sequence
  sgRNA
  NTC_2001
gggtaagcgcgcactcgatc

SEQ ID NO: 66749 - DNA, 20 bp, Artificial Sequence
  sgRNA
  NTC_2002
gacgagcgtaaatctcgact

SEQ ID NO: 66750 - DNA, 20 bp, Artificial Sequence
  sgRNA
  NTC_2003
cgttacaataagcgtaccct

SEQ ID NO: 66751 - DNA, 20 bp, Artificial Sequence
  sgRNA
  NTC_2004
gtttcaacgtcaaccgagac

SEQ ID NO: 66752 - DNA, 20 bp, Artificial Sequence
  sgRNA
  NTC_2005
gtctgacagaagaacgcgtc

SEQ ID NO: 66753 - DNA, 20 bp, Artificial Sequence
  sgRNA
  NTC_2006
acacgcggaagatcacgacg

SEQ ID NO: 66754 - DNA, 20 bp, Artificial Sequence
  sgRNA
  NTC_2007
gtggcagcgcgtctcgtcga

SEQ ID NO: 66755 - DNA, 20 bp, Artificial Sequence
  sgRNA
  NTC_2008
caggtgttctcgcacgattt

SEQ ID NO: 66756 - DNA, 20 bp, Artificial Sequence
  sgRNA
  NTC_2009
ctgctaacgcgcgatccata

SEQ ID NO: 66757 - DNA, 20 bp, Artificial Sequence
  sgRNA
  NTC_2010
cacttcagcgttcgcgaaag

SEQ ID NO: 66758 - DNA, 20 bp, Artificial Sequence
  sgRNA
  NTC_2011
tagctctagtgcgctgaacg

SEQ ID NO: 66759 - DNA, 20 bp, Artificial Sequence
  sgRNA
  NTC_2012
gcgacacgatctcctacgcc

SEQ ID NO: 66760 - DNA, 20 bp, Artificial Sequence
  sgRNA
  NTC_2013
gcggattgcgatagcgcacc

SEQ ID NO: 66761 - DNA, 20 bp, Artificial Sequence
  sgRNA
  NTC_2014
acgatcgtcgtcacgcttca

SEQ ID NO: 66762 - DNA, 20 bp, Artificial Sequence
  sgRNA
  NTC_2015
ctacacgctcggtcgagtac

SEQ ID NO: 66763 - DNA, 20 bp, Artificial Sequence
  sgRNA
  NTC_2016
acaggatgacttgcgcgttc

SEQ ID NO: 66764 - DNA, 20 bp, Artificial Sequence
  sgRNA
  NTC_2017
cgtcgtaacatagcgtccta

SEQ ID NO: 66765 - DNA, 20 bp, Artificial Sequence
  sgRNA
  NTC_2018
cgcgcgaaacgttgtccata

SEQ ID NO: 66766 - DNA, 20 bp, Artificial Sequence
  sgRNA
  NTC_2019
gatcggcgttcgattaacgc

SEQ ID NO: 66767 - DNA, 20 bp, Artificial Sequence
  sgRNA
  NTC_2020
agtttctagatcgcgcgttc

SEQ ID NO: 66768 - DNA, 20 bp, Artificial Sequence
  sgRNA
  NTC_2021
ctcggtcgcttacgttatac

SEQ ID NO: 66769 - DNA, 20 bp, Artificial Sequence
  sgRNA
  NTC_2022
aatcggagctgcatgagccg

SEQ ID NO: 66770 - DNA, 20 bp, Artificial Sequence
  sgRNA
  NTC_2023
gttaactaatcgccgcgtgt

SEQ ID NO: 66771 - DNA, 20 bp, Artificial Sequence
  sgRNA
  NTC_2024
tactgtcggtgaaccgcatt

SEQ ID NO: 66772 - DNA, 20 bp, Artificial Sequence
  sgRNA
  NTC_2025
tttgtgcgcacttcgcatcg

SEQ ID NO: 66773 - DNA, 20 bp, Artificial Sequence
  sgRNA
  NTC_2026
tcgctatgaacgctccgccc

SEQ ID NO: 66774 - DNA, 20 bp, Artificial Sequence
  sgRNA
  NTC_2027
atcgcggactactaaaacgc

SEQ ID NO: 66775 - DNA, 20 bp, Artificial Sequence
  sgRNA
  NTC_2028
tcgacgatgcacacgaacta

SEQ ID NO: 66776 - DNA, 20 bp, Artificial Sequence
  sgRNA
  NTC_2029
attcgcgcacaactctatta

SEQ ID NO: 66777 - DNA, 20 bp, Artificial Sequence
  sgRNA
  NTC_2030
gacaacaagacgcataccgt

SEQ ID NO: 66778 - DNA, 20 bp, Artificial Sequence
  sgRNA
  NTC_2031
acgcgtagagttgcgccaac

SEQ ID NO: 66779 - DNA, 20 bp, Artificial Sequence
  sgRNA
  NTC_2032
gtcggataggcgatcaacgc

SEQ ID NO: 66780 - DNA, 20 bp, Artificial Sequence
  sgRNA
  NTC_2033
atggagcggcgtccgttaaa

SEQ ID NO: 66781 - DNA, 20 bp, Artificial Sequence
  sgRNA
  NTC_2034
agcgtcgtcgcgttgcgtgc

SEQ ID NO: 66782 - DNA, 20 bp, Artificial Sequence
  sgRNA
  NTC_2035
cgacagtcggatcaccgcgt

SEQ ID NO: 66783 - DNA, 20 bp, Artificial Sequence
  sgRNA
  NTC_2036
acgtcggcgcataccgctaa

SEQ ID NO: 66784 - DNA, 20 bp, Artificial Sequence
  sgRNA
  NTC_2037
gatgacagctacgttagcga

SEQ ID NO: 66785 - DNA, 20 bp, Artificial Sequence
  sgRNA
  NTC_2038
gtcgcggtatgtcgatgaat

SEQ ID NO: 66786 - DNA, 20 bp, Artificial Sequence
  sgRNA
  NTC_2039
gttacggtttcgcaaccgtt

SEQ ID NO: 66787 - DNA, 20 bp, Artificial Sequence
  sgRNA
  NTC_2040
ttcataacaggacgtaacgc

SEQ ID NO: 66788 - DNA, 20 bp, Artificial Sequence
  sgRNA
  NTC_2041
gacgttctatcgccgaccat

SEQ ID NO: 66789 - DNA, 20 bp, Artificial Sequence
  sgRNA
  NTC_2042
acacgacgtatgtcgtgcac

SEQ ID NO: 66790 - DNA, 20 bp, Artificial Sequence
  sgRNA
  NTC_2043
tgcgacgacaacccgatcct

SEQ ID NO: 66791 - DNA, 20 bp, Artificial Sequence
  sgRNA
  NTC_2044
gttacgggggcgttcatctt

SEQ ID NO: 66792 - DNA, 20 bp, Artificial Sequence
  sgRNA
  NTC_2045
tatgaacgatacgacccctg

SEQ ID NO: 66793 - DNA, 20 bp, Artificial Sequence
  sgRNA
  NTC_2046
tgttggtatgtcacgcgccg

SEQ ID NO: 66794 - DNA, 20 bp, Artificial Sequence
  sgRNA
  NTC_2047
acgcatgactcgcgaacatc

SEQ ID NO: 66795 - DNA, 20 bp, Artificial Sequence
  sgRNA
  NTC_2048
gcgcgttacgcagcgagtag

SEQ ID NO: 66796 - DNA, 20 bp, Artificial Sequence
  sgRNA
  NTC_2049
cgcacgtcttcaaccgccga

SEQ ID NO: 66797 - DNA, 20 bp, Artificial Sequence
  sgRNA
  NTC_2050
cggcgcatattatgccgcat

SEQ ID NO: 66798 - DNA, 20 bp, Artificial Sequence
  sgRNA
  NTC_2051
ctcaagtggtctaccctacg

SEQ ID NO: 66799 - DNA, 20 bp, Artificial Sequence
  sgRNA
  NTC_2052
aaactagcgtaagttacgat

SEQ ID NO: 66800 - DNA, 20 bp, Artificial Sequence
  sgRNA
  NTC_2053
cgactcacgtagcaatacga

SEQ ID NO: 66801 - DNA, 20 bp, Artificial Sequence
  sgRNA
  NTC_2054
agacgcaaaacgcgccccca

SEQ ID NO: 66802 - DNA, 20 bp, Artificial Sequence
  sgRNA
  NTC_2055
gcgcgacgattacgccaccc

SEQ ID NO: 66803 - DNA, 20 bp, Artificial Sequence
  sgRNA
  NTC_2056
aattgcgggtataacgccgc

SEQ ID NO: 66804 - DNA, 20 bp, Artificial Sequence
  sgRNA
  NTC_2057
ttgcatgttctgtacgaccg

SEQ ID NO: 66805 - DNA, 20 bp, Artificial Sequence
  sgRNA
  NTC_2058
attaaatcgtacgacagcga

SEQ ID NO: 66806 - DNA, 20 bp, Artificial Sequence
  sgRNA
  NTC_2059
agtcatcgacgtaccagcgc

SEQ ID NO: 66807 - DNA, 20 bp, Artificial Sequence
  sgRNA
  NTC_2060
tgtcgtcgacggacaagatc

SEQ ID NO: 66808 - DNA, 20 bp, Artificial Sequence
  sgRNA
  NTC_2061
atagcgctttcgccgatgca

SEQ ID NO: 66809 - DNA, 20 bp, Artificial Sequence
  sgRNA
  NTC_2062
tgcgacgggactactacgat

SEQ ID NO: 66810 - DNA, 20 bp, Artificial Sequence
  sgRNA
  NTC_2063
tgcaattgaagccccgaacg

SEQ ID NO: 66811 - DNA, 20 bp, Artificial Sequence
  sgRNA
  NTC_2064
cacggtgcgaacgcgtacac

SEQ ID NO: 66812 - DNA, 20 bp, Artificial Sequence
  sgRNA
  NTC_2065
ttaatcagttcgcccgaacg

SEQ ID NO: 66813 - DNA, 20 bp, Artificial Sequence
  sgRNA
  NTC_2066
tcgggcgagtcaaacgatga

SEQ ID NO: 66814 - DNA, 20 bp, Artificial Sequence
  sgRNA
  NTC_2067
ttgacgggttagctgttacg

SEQ ID NO: 66815 - DNA, 20 bp, Artificial Sequence
  sgRNA
  NTC_2068
cgcggtatcatccgagcgtc

SEQ ID NO: 66816 - DNA, 20 bp, Artificial Sequence
  sgRNA
  NTC_2069
atcggagcgcatactatacg

SEQ ID NO: 66817 - DNA, 20 bp, Artificial Sequence
  sgRNA
  NTC_2070
taaacttcgcgcgacatcga

SEQ ID NO: 66818 - DNA, 20 bp, Artificial Sequence
  sgRNA
  NTC_2071
aattagaacggtcgagcacg

SEQ ID NO: 66819 - DNA, 20 bp, Artificial Sequence
  sgRNA
  NTC_2072
tgagtagtgtcgcctttatt

SEQ ID NO: 66820 - DNA, 20 bp, Artificial Sequence
  sgRNA
  NTC_2073
tgtcgggatcgcgccgcgta

SEQ ID NO: 66821 - DNA, 20 bp, Artificial Sequence
  sgRNA
  NTC_2074
ctcgtagagtcgttaccgcg

SEQ ID NO: 66822 - DNA, 20 bp, Artificial Sequence
  sgRNA
  NTC_2075
tcaggcgcgctattcaactt

SEQ ID NO: 66823 - DNA, 20 bp, Artificial Sequence
  sgRNA
  NTC_2076
gcactcggcacgtcgtgcgc

SEQ ID NO: 66824 - DNA, 20 bp, Artificial Sequence
  sgRNA
  NTC_2077
gcggcggcataagtctaact

SEQ ID NO: 66825 - DNA, 20 bp, Artificial Sequence
  sgRNA
  NTC_2078
cgcagcggtatacttcgagc

SEQ ID NO: 66826 - DNA, 20 bp, Artificial Sequence
  sgRNA
  NTC_2079
agttacaagtatcgcgttcg

SEQ ID NO: 66827 - DNA, 20 bp, Artificial Sequence
  sgRNA
  NTC_2080
tggcgacgcacgtgagctaa

SEQ ID NO: 66828 - DNA, 20 bp, Artificial Sequence
  sgRNA
  NTC_2081
cgcatgactcgttccgcgcg

SEQ ID NO: 66829 - DNA, 20 bp, Artificial Sequence
  sgRNA
  NTC_2082
cttacgagttgttcgatcgt

SEQ ID NO: 66830 - DNA, 20 bp, Artificial Sequence
  sgRNA
  NTC_2083
tagtcgtgctaccgcgataa

SEQ ID NO: 66831 - DNA, 20 bp, Artificial Sequence
  sgRNA
  NTC_2084
gagacggtattattagtcgc

SEQ ID NO: 66832 - DNA, 20 bp, Artificial Sequence
  sgRNA
  NTC_2085
tctgtatgaacaaccgttat

SEQ ID NO: 66833 - DNA, 20 bp, Artificial Sequence
  sgRNA
  NTC_2086
caacaaactgcgagcgatag

SEQ ID NO: 66834 - DNA, 20 bp, Artificial Sequence
  sgRNA
  NTC_2087
tattcatcagacgcctcgtt

SEQ ID NO: 66835 - DNA, 20 bp, Artificial Sequence
  sgRNA
  NTC_2088
gtgggttatacgcgcattac

SEQ ID NO: 66836 - DNA, 20 bp, Artificial Sequence
  sgRNA
  NTC_2089
ggggtttggtcgcacgcgta

SEQ ID NO: 66837 - DNA, 20 bp, Artificial Sequence
  sgRNA
  NTC_2090
acgacttcgtgtcgctacgc

SEQ ID NO: 66838 - DNA, 20 bp, Artificial Sequence
  sgRNA
  NTC_2091
atctagcgttagcgatagcc

SEQ ID NO: 66839 - DNA, 20 bp, Artificial Sequence
  sgRNA
  NTC_2092
cggcggagcgttacgtagtc

SEQ ID NO: 66840 - DNA, 20 bp, Artificial Sequence
  sgRNA
  NTC_2093
acacgggtggctcgtacgat

SEQ ID NO: 66841 - DNA, 20 bp, Artificial Sequence
  sgRNA
  NTC_2094
tttacgcgtgaacgaccgac

SEQ ID NO: 66842 - DNA, 20 bp, Artificial Sequence
  sgRNA
  NTC_2095
agacgcgtcagttgcgcgtc

SEQ ID NO: 66843 - DNA, 20 bp, Artificial Sequence
  sgRNA
  NTC_2096
gatacggtgacgtctaatcc

SEQ ID NO: 66844 - DNA, 20 bp, Artificial Sequence
  sgRNA
  NTC_2097
gatgcggctcaccgataata

SEQ ID NO: 66845 - DNA, 20 bp, Artificial Sequence
  sgRNA
  NTC_2098
gtcgtaagatcgtcttgccg

SEQ ID NO: 66846 - DNA, 20 bp, Artificial Sequence
  sgRNA
  NTC_2099
gcgcgagaagcgcacttcgt

SEQ ID NO: 66847 - DNA, 20 bp, Artificial Sequence
  sgRNA
  NTC_2100
cagatcaagtagagcgcgat

SEQ ID NO: 66848 - DNA, 20 bp, Artificial Sequence
  sgRNA
  NTC_2101
actatatgcgcgctatgcgc

SEQ ID NO: 66849 - DNA, 20 bp, Artificial Sequence
  sgRNA
  NTC_2102
atacatcgttctgtcgcgca

SEQ ID NO: 66850 - DNA, 20 bp, Artificial Sequence
  sgRNA
  NTC_2103
ctcgggcgtggctgcgaata

SEQ ID NO: 66851 - DNA, 20 bp, Artificial Sequence
  sgRNA
  NTC_2104
aggcacgcgcgtgataagtt

SEQ ID NO: 66852 - DNA, 20 bp, Artificial Sequence
  sgRNA
  NTC_2105
caacatcgctggtacgttaa

SEQ ID NO: 66853 - DNA, 20 bp, Artificial Sequence
  sgRNA
  NTC_2106
atgcgttcgagttcgcgaaa

SEQ ID NO: 66854 - DNA, 20 bp, Artificial Sequence
  sgRNA
  NTC_2107
atataacttgcgcgccgaga

SEQ ID NO: 66855 - DNA, 20 bp, Artificial Sequence
  sgRNA
  NTC_2108
cggaatgcgtgccgctttat

SEQ ID NO: 66856 - DNA, 20 bp, Artificial Sequence
  sgRNA
  NTC_2109
gcgtaactgattgcgcgctt

SEQ ID NO: 66857 - DNA, 20 bp, Artificial Sequence
  sgRNA
  NTC_2110
gttgaggtcgatccgttctt

SEQ ID NO: 66858 - DNA, 20 bp, Artificial Sequence
  sgRNA
  NTC_2111
tcgagtgcatcgcgagagta

SEQ ID NO: 66859 - DNA, 20 bp, Artificial Sequence
  sgRNA
  NTC_2112
tgtaatgcgtgtatcccgcg

SEQ ID NO: 66860 - DNA, 20 bp, Artificial Sequence
  sgRNA
  NTC_2113
acggctatcacattcgaatt

SEQ ID NO: 66861 - DNA, 20 bp, Artificial Sequence
  sgRNA
  NTC_2114
gagtcggattggagcgaccg

SEQ ID NO: 66862 - DNA, 20 bp, Artificial Sequence
  sgRNA
  NTC_2115
ggggtgcaattccgcacgac

SEQ ID NO: 66863 - DNA, 20 bp, Artificial Sequence
  sgRNA
  NTC_2116
tagtgcacgggtcgttagcg

SEQ ID NO: 66864 - DNA, 20 bp, Artificial Sequence
  sgRNA
  NTC_2117
cttcatgtctatagcgctcg

SEQ ID NO: 66865 - DNA, 20 bp, Artificial Sequence
  sgRNA
  NTC_2118
ggttgggttcgccgaatgcg

SEQ ID NO: 66866 - DNA, 20 bp, Artificial Sequence
  sgRNA
  NTC_2119
agtggtacgtatcgccgaca

SEQ ID NO: 66867 - DNA, 20 bp, Artificial Sequence
  sgRNA
  NTC_2120
atgaacgagtgtcgagcgac

SEQ ID NO: 66868 - DNA, 20 bp, Artificial Sequence
  sgRNA
  NTC_2121
tgagtatctcgccgcttatc

SEQ ID NO: 66869 - DNA, 20 bp, Artificial Sequence
  sgRNA
  NTC_2122
tgattcggctagttcgtact

SEQ ID NO: 66870 - DNA, 20 bp, Artificial Sequence
  sgRNA
  NTC_2123
acggttactcgtcgacctaa

SEQ ID NO: 66871 - DNA, 20 bp, Artificial Sequence
  sgRNA
  NTC_2124
tcggaatagcgccgatcacc

SEQ ID NO: 66872 - DNA, 20 bp, Artificial Sequence
  sgRNA
  NTC_2125
ttcgggcggttagtttcacg

SEQ ID NO: 66873 - DNA, 20 bp, Artificial Sequence
  sgRNA
  NTC_2126
atcggctcagtatcaatcgt

SEQ ID NO: 66874 - DNA, 20 bp, Artificial Sequence
  sgRNA
  NTC_2127
ggctagatcggtcgactctt

SEQ ID NO: 66875 - DNA, 20 bp, Artificial Sequence
  sgRNA
  NTC_2128
gatcaatctacgtacgtcga

SEQ ID NO: 66876 - DNA, 20 bp, Artificial Sequence
  sgRNA
  NTC_2129
gacgtacgatcgttcctatc

SEQ ID NO: 66877 - DNA, 20 bp, Artificial Sequence
  sgRNA
  NTC_2130
ggcgtgattgacgcgccttg

SEQ ID NO: 66878 - DNA, 20 bp, Artificial Sequence
  sgRNA
  NTC_2131
tataatacgttacccgccta

SEQ ID NO: 66879 - DNA, 20 bp, Artificial Sequence
  sgRNA
  NTC_2132
gtcgatgcggtacgaacctc

SEQ ID NO: 66880 - DNA, 20 bp, Artificial Sequence
  sgRNA
  NTC_2133
gaaactgcgcgcgtaagtta

SEQ ID NO: 66881 - DNA, 20 bp, Artificial Sequence
  sgRNA
  NTC_2134
cgctaacggcgtagccgcta

SEQ ID NO: 66882 - DNA, 20 bp, Artificial Sequence
  sgRNA
  NTC_2135
gggcgaatgcaattcgctat

SEQ ID NO: 66883 - DNA, 20 bp, Artificial Sequence
  sgRNA
  NTC_2136
tgttacttcaaccgtacccg

SEQ ID NO: 66884 - DNA, 20 bp, Artificial Sequence
  sgRNA
  NTC_2137
tcgtcaggtcaacaacgcgt

SEQ ID NO: 66885 - DNA, 20 bp, Artificial Sequence
  sgRNA
  NTC_2138
ctcgtaacgatccacgatgc

SEQ ID NO: 66886 - DNA, 20 bp, Artificial Sequence
  sgRNA
  NTC_2139
cgacgaagtcgcatccatcg

SEQ ID NO: 66887 - DNA, 20 bp, Artificial Sequence
  sgRNA
  NTC_2140
tcgggattacattaattacg

SEQ ID NO: 66888 - DNA, 20 bp, Artificial Sequence
  sgRNA
  NTC_2141
aagttgcacttatgcgacgt

SEQ ID NO: 66889 - DNA, 20 bp, Artificial Sequence
  sgRNA
  NTC_2142
cggatcaaatgacgcgcgac

SEQ ID NO: 66890 - DNA, 20 bp, Artificial Sequence
  sgRNA
  NTC_2143
ctaacggaggcgatcgcagt

SEQ ID NO: 66891 - DNA, 20 bp, Artificial Sequence
  sgRNA
  NTC_2144
aagtctaacgtttcgccgac

SEQ ID NO: 66892 - DNA, 20 bp, Artificial Sequence
  sgRNA
  NTC_2145
aaacatgcgtgcaccgacct

SEQ ID NO: 66893 - DNA, 20 bp, Artificial Sequence
  sgRNA
  NTC_2146
ggcgcagttattactccgcg

SEQ ID NO: 66894 - DNA, 20 bp, Artificial Sequence
  sgRNA
  NTC_2147
ttaggacgcgtctaacgcct

SEQ ID NO: 66895 - DNA, 20 bp, Artificial Sequence
  sgRNA
  NTC_2148
tgtatgtaacacttcgcatc

SEQ ID NO: 66896 - DNA, 20 bp, Artificial Sequence
  sgRNA
  NTC_2149
cgcgtaggacgtcctaagag

SEQ ID NO: 66897 - DNA, 20 bp, Artificial Sequence
  sgRNA
  NTC_2150
cggcgtacggaactcttacg

SEQ ID NO: 66898 - DNA, 20 bp, Artificial Sequence
  sgRNA
  NTC_2151
ttctgcgtagtacgcaacgt

SEQ ID NO: 66899 - DNA, 20 bp, Artificial Sequence
  sgRNA
  NTC_2152
tcgcacggaatctgtcgatc

SEQ ID NO: 66900 - DNA, 20 bp, Artificial Sequence
  sgRNA
  NTC_2153
gcttacgcgctgacgcatac

SEQ ID NO: 66901 - DNA, 20 bp, Artificial Sequence
  sgRNA
  NTC_2154
tacgacgggcgtcatctgtt

SEQ ID NO: 66902 - DNA, 20 bp, Artificial Sequence
  sgRNA
  NTC_2155
cgtgtcgtaaatcgacatcg

SEQ ID NO: 66903 - DNA, 20 bp, Artificial Sequence
  sgRNA
  NTC_2156
gtcgctaaacgtatatttcg

SEQ ID NO: 66904 - DNA, 20 bp, Artificial Sequence
  sgRNA
  NTC_2157
ggacgctacgagcgagaacg

SEQ ID NO: 66905 - DNA, 20 bp, Artificial Sequence
  sgRNA
  NTC_2158
cacatgctcggcgacgccat

SEQ ID NO: 66906 - DNA, 20 bp, Artificial Sequence
  sgRNA
  NTC_2159
ttcgtgttgaatcccgcgag

SEQ ID NO: 66907 - DNA, 20 bp, Artificial Sequence
  sgRNA
  NTC_2160
gagttgtttacacgcgacgc

SEQ ID NO: 66908 - DNA, 20 bp, Artificial Sequence
  sgRNA
  NTC_2161
gttacgtggcgcccaatact

SEQ ID NO: 66909 - DNA, 20 bp, Artificial Sequence
  sgRNA
  NTC_2162
gaacgagcgcgtcgcgaaga

SEQ ID NO: 66910 - DNA, 20 bp, Artificial Sequence
  sgRNA
  NTC_2163
tcgacgcgtaacccctattg

SEQ ID NO: 66911 - DNA, 20 bp, Artificial Sequence
  sgRNA
  NTC_2164
gcggcgaataatgttactat

SEQ ID NO: 66912 - DNA, 20 bp, Artificial Sequence
  sgRNA
  NTC_2165
cgtgcttcgcggaatactag

SEQ ID NO: 66913 - DNA, 20 bp, Artificial Sequence
  sgRNA
  NTC_2166
atggacgtggtgtcgacgtc

SEQ ID NO: 66914 - DNA, 20 bp, Artificial Sequence
  sgRNA
  NTC_2167
gctacggacggtcacgttat

SEQ ID NO: 66915 - DNA, 20 bp, Artificial Sequence
  sgRNA
  NTC_2168
ggctggcgacgtaccccgat

SEQ ID NO: 66916 - DNA, 20 bp, Artificial Sequence
  sgRNA
  NTC_2169
agctagggtcactacgcgcg

SEQ ID NO: 66917 - DNA, 20 bp, Artificial Sequence
  sgRNA
  NTC_2170
tcgggaaagacgtcctatac

SEQ ID NO: 66918 - DNA, 20 bp, Artificial Sequence
  sgRNA
  NTC_2171
cgcgtatctatagaccttaa

SEQ ID NO: 66919 - DNA, 20 bp, Artificial Sequence
  sgRNA
  NTC_2172
taggcgcgaagcttcgcagt

SEQ ID NO: 66920 - DNA, 20 bp, Artificial Sequence
  sgRNA
  NTC_2173
cgagcgctctactgcgattg

SEQ ID NO: 66921 - DNA, 20 bp, Artificial Sequence
  sgRNA
  NTC_2174
taggacttcgtacgcgaaaa

SEQ ID NO: 66922 - DNA, 20 bp, Artificial Sequence
  sgRNA
  NTC_2175
atcgaatgcacgatacttga

SEQ ID NO: 66923 - DNA, 20 bp, Artificial Sequence
  sgRNA
  NTC_2176
gtcgggcgtttccccgcgtc

SEQ ID NO: 66924 - DNA, 20 bp, Artificial Sequence
  sgRNA
  NTC_2177
actcgataatggatgccgcg

SEQ ID NO: 66925 - DNA, 20 bp, Artificial Sequence
  sgRNA
  NTC_2178
tcaggcgttggacttcgcga

SEQ ID NO: 66926 - DNA, 20 bp, Artificial Sequence
  sgRNA
  NTC_2179
atagcgcgtttcgcgtcaac

SEQ ID NO: 66927 - DNA, 20 bp, Artificial Sequence
  sgRNA
  NTC_2180
gctcatgtaaagaacgattc

SEQ ID NO: 66928 - DNA, 20 bp, Artificial Sequence
  sgRNA
  NTC_2181
gtttcgggcgagccatacgc

SEQ ID NO: 66929 - DNA, 20 bp, Artificial Sequence
  sgRNA
  NTC_2182
acaggcgacgtcgctacgca

SEQ ID NO: 66930 - DNA, 20 bp, Artificial Sequence
  sgRNA
  NTC_2183
tcgtatgcggcaaatcccac

SEQ ID NO: 66931 - DNA, 20 bp, Artificial Sequence
  sgRNA
  NTC_2184
cacgctacgctagcgcgcct

SEQ ID NO: 66932 - DNA, 20 bp, Artificial Sequence
  sgRNA
  NTC_2185
tgacgttgcataaacgcgca

SEQ ID NO: 66933 - DNA, 20 bp, Artificial Sequence
  sgRNA
  NTC_2186
tatactacgtgccgaactcc

SEQ ID NO: 66934 - DNA, 20 bp, Artificial Sequence
  sgRNA
  NTC_2187
tacgcgcacaactacccgat

SEQ ID NO: 66935 - DNA, 20 bp, Artificial Sequence
  sgRNA
  NTC_2188
tgcgttcgtcgcgaacgaag

SEQ ID NO: 66936 - DNA, 20 bp, Artificial Sequence
  sgRNA
  NTC_2189
gaatcacgcggttctaccgt

SEQ ID NO: 66937 - DNA, 20 bp, Artificial Sequence
  sgRNA
  NTC_2190
gtgaatgactatgccgtacg

SEQ ID NO: 66938 - DNA, 20 bp, Artificial Sequence
  sgRNA
  NTC_2191
cggatacgcggcttagtagc

SEQ ID NO: 66939 - DNA, 20 bp, Artificial Sequence
  sgRNA
  NTC_2192
tggcgggcggatccgaaata

SEQ ID NO: 66940 - DNA, 20 bp, Artificial Sequence
  sgRNA
  NTC_2193
ctgagttcgacgtttcgtgt

SEQ ID NO: 66941 - DNA, 20 bp, Artificial Sequence
  sgRNA
  NTC_2194
cggtctgacgaaccgctatg

SEQ ID NO: 66942 - DNA, 20 bp, Artificial Sequence
  sgRNA
  NTC_2195
aacggcgggtctaacgttca

SEQ ID NO: 66943 - DNA, 20 bp, Artificial Sequence
  sgRNA
  NTC_2196
agttcggtagattcgtcacg

SEQ ID NO: 66944 - DNA, 20 bp, Artificial Sequence
  sgRNA
  NTC_2197
atcgtttcgcgaacgtactg

SEQ ID NO: 66945 - DNA, 20 bp, Artificial Sequence
  sgRNA
  NTC_2198
tatggacggcgcaaaatcac

SEQ ID NO: 66946 - DNA, 20 bp, Artificial Sequence
  sgRNA
  NTC_2199
gtggcggcatgcgacgtcgt

SEQ ID NO: 66947 - DNA, 20 bp, Artificial Sequence
  sgRNA
  NTC_2200
ttacggcgtcgactgatagt

SEQ ID NO: 66948 - DNA, 20 bp, Artificial Sequence
  sgRNA
  NTC_2201
ggcggaatactatcgcgacc

SEQ ID NO: 66949 - DNA, 20 bp, Artificial Sequence
  sgRNA
  NTC_2202
catcaggcgtcgccgaattg

SEQ ID NO: 66950 - DNA, 20 bp, Artificial Sequence
  sgRNA
  NTC_2203
ttcgcgcatgtcgtttaccg

SEQ ID NO: 66951 - DNA, 20 bp, Artificial Sequence
  sgRNA
  NTC_2204
catgtgtttacgccgcgttg

SEQ ID NO: 66952 - DNA, 20 bp, Artificial Sequence
  sgRNA
  NTC_2205
cggcgacgagatcgaaccat

SEQ ID NO: 66953 - DNA, 20 bp, Artificial Sequence
  sgRNA
  NTC_2206
actgactagtcgcgcgttat

SEQ ID NO: 66954 - DNA, 20 bp, Artificial Sequence
  sgRNA
  NTC_2207
gttcgcggcggatttccgag

SEQ ID NO: 66955 - DNA, 20 bp, Artificial Sequence
  sgRNA
  NTC_2208
gcgaagtagacgtgaacgtc

SEQ ID NO: 66956 - DNA, 20 bp, Artificial Sequence
  sgRNA
  NTC_2209
gcactcggaatcgtttgaac

SEQ ID NO: 66957 - DNA, 20 bp, Artificial Sequence
  sgRNA
  NTC_2210
tcgcgctttaaacgcgaacc

SEQ ID NO: 66958 - DNA, 20 bp, Artificial Sequence
  sgRNA
  NTC_2211
acgtgcggggcgcgttattt

SEQ ID NO: 66959 - DNA, 20 bp, Artificial Sequence
  sgRNA
  NTC_2212
ggtttgtcgatgatcgagcg

SEQ ID NO: 66960 - DNA, 20 bp, Artificial Sequence
  sgRNA
  NTC_2213
tacgagcgggaatgcaaccg

SEQ ID NO: 66961 - DNA, 20 bp, Artificial Sequence
  sgRNA
  NTC_2214
tttcgcacggcgctattaac

SEQ ID NO: 66962 - DNA, 20 bp, Artificial Sequence
  sgRNA
  NTC_2215
cggcagacacattacgcaac

SEQ ID NO: 66963 - DNA, 20 bp, Artificial Sequence
  sgRNA
  NTC_2216
cgagtctgagatcgcgtact

SEQ ID NO: 66964 - DNA, 20 bp, Artificial Sequence
  sgRNA
  NTC_2217
ggatgcgaagcgattcgccg

SEQ ID NO: 66965 - DNA, 20 bp, Artificial Sequence
  sgRNA
  NTC_2218
aaagcagactagtcgccgct

SEQ ID NO: 66966 - DNA, 20 bp, Artificial Sequence
  sgRNA
  NTC_2219
acgtctatcacgaccgaagt

SEQ ID NO: 66967 - DNA, 20 bp, Artificial Sequence
  sgRNA
  NTC_2220
acactattcgcgcccgcgca

SEQ ID NO: 66968 - DNA, 20 bp, Artificial Sequence
  sgRNA
  NTC_2221
ggggcgacgtcacgcgagat

SEQ ID NO: 66969 - DNA, 20 bp, Artificial Sequence
  sgRNA
  NTC_2222
ggagtgatgtcgaccgctaa

SEQ ID NO: 66970 - DNA, 20 bp, Artificial Sequence
  sgRNA
  NTC_2223
acggtggaatacccgacgtg

SEQ ID NO: 66971 - DNA, 20 bp, Artificial Sequence
  sgRNA
  NTC_2224
tgagcgtgaactcgttacat

SEQ ID NO: 66972 - DNA, 20 bp, Artificial Sequence
  sgRNA
  NTC_2225
gggggtgttacgcgatctac

SEQ ID NO: 66973 - DNA, 20 bp, Artificial Sequence
  sgRNA
  NTC_2226
ttcgtgtatcgcaacagacg

SEQ ID NO: 66974 - DNA, 20 bp, Artificial Sequence
  sgRNA
  NTC_2227
cggtatactgatactccgct

SEQ ID NO: 66975 - DNA, 20 bp, Artificial Sequence
  sgRNA
  NTC_2228
caagacacgcgtcgactcgc

SEQ ID NO: 66976 - DNA, 20 bp, Artificial Sequence
  sgRNA
  NTC_2229
atgtcgcgcgcgtaatgcgt

SEQ ID NO: 66977 - DNA, 20 bp, Artificial Sequence
  sgRNA
  NTC_2230
tgtgcaatatttcacgcaac

SEQ ID NO: 66978 - DNA, 20 bp, Artificial Sequence
  sgRNA
  NTC_2231
ggattcgacggtacgccccc

SEQ ID NO: 66979 - DNA, 20 bp, Artificial Sequence
  sgRNA
  NTC_2232
tagtcgcggcttaacgccca

SEQ ID NO: 66980 - DNA, 20 bp, Artificial Sequence
  sgRNA
  NTC_2233
gcttgacgagcgttccgacc

SEQ ID NO: 66981 - DNA, 20 bp, Artificial Sequence
  sgRNA
  NTC_2234
tcggtcgcggacgcgcgaca

SEQ ID NO: 66982 - DNA, 20 bp, Artificial Sequence
  sgRNA
  NTC_2235
gagacgttattccgcgccta

SEQ ID NO: 66983 - DNA, 20 bp, Artificial Sequence
  sgRNA
  NTC_2236
cttcaggcgatcgtcacgcc

SEQ ID NO: 66984 - DNA, 20 bp, Artificial Sequence
  sgRNA
  NTC_2237
gagcgtggacgctgatcgta

SEQ ID NO: 66985 - DNA, 20 bp, Artificial Sequence
  sgRNA
  NTC_2238
tcggtgaatgcgtccgacac

SEQ ID NO: 66986 - DNA, 20 bp, Artificial Sequence
  sgRNA
  NTC_2239
tctatagacgcgcgcccacc

SEQ ID NO: 66987 - DNA, 20 bp, Artificial Sequence
  sgRNA
  NTC_2240
ggtttactggcgcccgtcgt

SEQ ID NO: 66988 - DNA, 20 bp, Artificial Sequence
  sgRNA
  NTC_2241
cgcgtattcgcgttatatta

SEQ ID NO: 66989 - DNA, 20 bp, Artificial Sequence
  sgRNA
  NTC_2242
attgggtcgctaccgcatta

SEQ ID NO: 66990 - DNA, 20 bp, Artificial Sequence
  sgRNA
  NTC_2243
tggcgcgggaatgtgcgtac

SEQ ID NO: 66991 - DNA, 20 bp, Artificial Sequence
  sgRNA
  NTC_2244
gtcgcgagcaacgaccatcg

SEQ ID NO: 66992 - DNA, 20 bp, Artificial Sequence
  sgRNA
  NTC_2245
acgacgctttaacgaatagc

SEQ ID NO: 66993 - DNA, 20 bp, Artificial Sequence
  sgRNA
  NTC_2246
gcgacagctgtattcgatcg

SEQ ID NO: 66994 - DNA, 20 bp, Artificial Sequence
  sgRNA
  NTC_2247
actgcttaagaccgccgtac

SEQ ID NO: 66995 - DNA, 20 bp, Artificial Sequence
  sgRNA
  NTC_2248
tcaacatttacgacgcctcc

SEQ ID NO: 66996 - DNA, 20 bp, Artificial Sequence
  sgRNA
  NTC_2249
tatgatacatgctgcgttac

SEQ ID NO: 66997 - DNA, 20 bp, Artificial Sequence
  sgRNA
  NTC_2250
tggcacgacaatgcgcgaca

SEQ ID NO: 66998 - DNA, 20 bp, Artificial Sequence
  sgRNA
  NTC_2251
gggcacggctaaccacgtta

SEQ ID NO: 66999 - DNA, 20 bp, Artificial Sequence
  sgRNA
  NTC_2252
cggggcggcgcgatcagaat

SEQ ID NO: 67000 - DNA, 20 bp, Artificial Sequence
  sgRNA
  NTC_2253
caaggaaaattccccgcgct

SEQ ID NO: 67001 - DNA, 20 bp, Artificial Sequence
  sgRNA
  NTC_2254
tttggtcatgcgcgtattac

SEQ ID NO: 67002 - DNA, 20 bp, Artificial Sequence
  sgRNA
  NTC_2255
tcatcgcgcgcttacaattg

SEQ ID NO: 67003 - DNA, 20 bp, Artificial Sequence
  sgRNA
  NTC_2256
cggtacatctctacgttgct

SEQ ID NO: 67004 - DNA, 20 bp, Artificial Sequence
  sgRNA
  NTC_2257
gacgcgcactgtcgacttta

SEQ ID NO: 67005 - DNA, 20 bp, Artificial Sequence
  sgRNA
  NTC_2258
cgcagcgattacatccacta

SEQ ID NO: 67006 - DNA, 20 bp, Artificial Sequence
  sgRNA
  NTC_2259
acgtattgcggatacgttta

SEQ ID NO: 67007 - DNA, 20 bp, Artificial Sequence
  sgRNA
  NTC_2260
gcgcgggggaactcgattgt

SEQ ID NO: 67008 - DNA, 20 bp, Artificial Sequence
  sgRNA
  NTC_2261
acattggcgcgcgtgaacaa

SEQ ID NO: 67009 - DNA, 20 bp, Artificial Sequence
  sgRNA
  NTC_2262
ttagcttcaaatcgcgtgta

SEQ ID NO: 67010 - DNA, 20 bp, Artificial Sequence
  sgRNA
  NTC_2263
acggctttacgcgtagaccg

SEQ ID NO: 67011 - DNA, 20 bp, Artificial Sequence
  sgRNA
  NTC_2264
cggcactttcagaaccgtac

SEQ ID NO: 67012 - DNA, 20 bp, Artificial Sequence
  sgRNA
  NTC_2265
attgcgctgctgcacgaatt

SEQ ID NO: 67013 - DNA, 20 bp, Artificial Sequence
  sgRNA
  NTC_2266
tacgagcaggaacttacgat

SEQ ID NO: 67014 - DNA, 20 bp, Artificial Sequence
  sgRNA
  NTC_2267
taacgtcgatcgctcgtttc

SEQ ID NO: 67015 - DNA, 20 bp, Artificial Sequence
  sgRNA
  NTC_2268
atcgggctgtggagcgtaca

SEQ ID NO: 67016 - DNA, 20 bp, Artificial Sequence
  sgRNA
  NTC_2269
ttaagggatcatcgcgactc

SEQ ID NO: 67017 - DNA, 20 bp, Artificial Sequence
  sgRNA
  NTC_2270
aattgcgaaacttcgcccca

SEQ ID NO: 67018 - DNA, 20 bp, Artificial Sequence
  sgRNA
  NTC_2271
gaatacgtgcgtattcgatt

SEQ ID NO: 67019 - DNA, 20 bp, Artificial Sequence
  sgRNA
  NTC_2272
gagtcatcgcggatcgttct

SEQ ID NO: 67020 - DNA, 20 bp, Artificial Sequence
  sgRNA
  NTC_2273
cgcgttaatcgctaagcgag

SEQ ID NO: 67021 - DNA, 20 bp, Artificial Sequence
  sgRNA
  NTC_2274
tcgttcgcgttaacgtctct

SEQ ID NO: 67022 - DNA, 20 bp, Artificial Sequence
  sgRNA
  NTC_2275
gcgggacgataccgagattg

SEQ ID NO: 67023 - DNA, 20 bp, Artificial Sequence
  sgRNA
  NTC_2276
tcagcgcagggcatcgctct

SEQ ID NO: 67024 - DNA, 20 bp, Artificial Sequence
  sgRNA
  NTC_2277
ttctaagcgtctcgcgccga

SEQ ID NO: 67025 - DNA, 20 bp, Artificial Sequence
  sgRNA
  NTC_2278
gctcggtcgtcgcatcattc

SEQ ID NO: 67026 - DNA, 20 bp, Artificial Sequence
  sgRNA
  NTC_2279
cgtctctaactatgcgaacg

SEQ ID NO: 67027 - DNA, 20 bp, Artificial Sequence
  sgRNA
  NTC_2280
cgcgatacgaatcacatacc

SEQ ID NO: 67028 - DNA, 20 bp, Artificial Sequence
  sgRNA
  NTC_2281
tcgcagtttattacccgtcg

SEQ ID NO: 67029 - DNA, 20 bp, Artificial Sequence
  sgRNA
  NTC_2282
gtaagcaacgacgcgcgcct

SEQ ID NO: 67030 - DNA, 20 bp, Artificial Sequence
  sgRNA
  NTC_2283
ggtcgatgcggattacgtgc

SEQ ID NO: 67031 - DNA, 20 bp, Artificial Sequence
  sgRNA
  NTC_2284
cgcgtgcttgtgtcgataac

SEQ ID NO: 67032 - DNA, 20 bp, Artificial Sequence
  sgRNA
  NTC_2285
tcgtatagggtcaatcgaca

SEQ ID NO: 67033 - DNA, 20 bp, Artificial Sequence
  sgRNA
  NTC_2286
caacggggcgattcactata

SEQ ID NO: 67034 - DNA, 20 bp, Artificial Sequence
  sgRNA
  NTC_2287
gactgacggctgaacgctta

SEQ ID NO: 67035 - DNA, 20 bp, Artificial Sequence
  sgRNA
  NTC_2288
ggcaagaggcgatccgcata

SEQ ID NO: 67036 - DNA, 20 bp, Artificial Sequence
  sgRNA
  NTC_2289
acgctctcgtacgcgtccag

SEQ ID NO: 67037 - DNA, 20 bp, Artificial Sequence
  sgRNA
  NTC_2290
cggttgaatagaactcatcg

SEQ ID NO: 67038 - DNA, 20 bp, Artificial Sequence
  sgRNA
  NTC_2291
atgaactaagtccgcgaaat

SEQ ID NO: 67039 - DNA, 20 bp, Artificial Sequence
  sgRNA
  NTC_2292
gagtagagcaacgcgatcgc

SEQ ID NO: 67040 - DNA, 20 bp, Artificial Sequence
  sgRNA
  NTC_2293
ctagtagtaaggtcgacgcc

SEQ ID NO: 67041 - DNA, 20 bp, Artificial Sequence
  sgRNA
  NTC_2294
gcttgtcgagtactcttcga

SEQ ID NO: 67042 - DNA, 20 bp, Artificial Sequence
  sgRNA
  NTC_2295
cgcattacggctgctcgtaa

SEQ ID NO: 67043 - DNA, 20 bp, Artificial Sequence
  sgRNA
  NTC_2296
atatcgtcgtatatcgagtt

SEQ ID NO: 67044 - DNA, 20 bp, Artificial Sequence
  sgRNA
  NTC_2297
atttatgtacggcgacgcat

SEQ ID NO: 67045 - DNA, 20 bp, Artificial Sequence
  sgRNA
  NTC_2298
acgcaatgtaggttaacgtc

SEQ ID NO: 67046 - DNA, 20 bp, Artificial Sequence
  sgRNA
  NTC_2299
atgtggcagactcgccatcg

SEQ ID NO: 67047 - DNA, 20 bp, Artificial Sequence
  sgRNA
  NTC_2300
agcgcgtagactcgtcgcac

SEQ ID NO: 67048 - DNA, 20 bp, Artificial Sequence
  sgRNA
  NTC_2301
gtgcaatgattagacatcgc

SEQ ID NO: 67049 - DNA, 20 bp, Artificial Sequence
  sgRNA
  NTC_2302
tcgttcgcgtggacactctt

SEQ ID NO: 67050 - DNA, 20 bp, Artificial Sequence
  sgRNA
  NTC_2303
acgggtgctgctcgtcgtat

SEQ ID NO: 67051 - DNA, 20 bp, Artificial Sequence
  sgRNA
  NTC_2304
tagttctaattccgcgacct

SEQ ID NO: 67052 - DNA, 20 bp, Artificial Sequence
  sgRNA
  NTC_2305
aggcgtctgcaacgcccgtc

SEQ ID NO: 67053 - DNA, 20 bp, Artificial Sequence
  sgRNA
  NTC_2306
catagattagcgcgatacca

SEQ ID NO: 67054 - DNA, 20 bp, Artificial Sequence
  sgRNA
  NTC_2307
agcgaacggggtcgctgtac

SEQ ID NO: 67055 - DNA, 20 bp, Artificial Sequence
  sgRNA
  NTC_2308
gattgtcagtctaccgatgt

SEQ ID NO: 67056 - DNA, 20 bp, Artificial Sequence
  sgRNA
  NTC_2309
ggtgcattagtcgttacgcg

SEQ ID NO: 67057 - DNA, 20 bp, Artificial Sequence
  sgRNA
  NTC_2310
cggtggctacacgccgttaa

SEQ ID NO: 67058 - DNA, 20 bp, Artificial Sequence
  sgRNA
  NTC_2311
ttacgagcagaccttgcgac

SEQ ID NO: 67059 - DNA, 20 bp, Artificial Sequence
  sgRNA
  NTC_2312
gacgatcgcgtgtcgaatta

SEQ ID NO: 67060 - DNA, 20 bp, Artificial Sequence
  sgRNA
  NTC_2313
cagttcgcaataatacgttc

SEQ ID NO: 67061 - DNA, 20 bp, Artificial Sequence
  sgRNA
  NTC_2314
cgagtcaatcaacccgtccg

SEQ ID NO: 67062 - DNA, 20 bp, Artificial Sequence
  sgRNA
  NTC_2315
cattattggcggtccgcact

SEQ ID NO: 67063 - DNA, 20 bp, Artificial Sequence
  sgRNA
  NTC_2316
taacgtgctagcgcacgctt

SEQ ID NO: 67064 - DNA, 20 bp, Artificial Sequence
  sgRNA
  NTC_2317
ttacgcgagcaccataattt

SEQ ID NO: 67065 - DNA, 20 bp, Artificial Sequence
  sgRNA
  NTC_2318
tggggggtcacgttccgaaa

SEQ ID NO: 67066 - DNA, 20 bp, Artificial Sequence
  sgRNA
  NTC_2319
tatcgttcaacgtgcgcttt

SEQ ID NO: 67067 - DNA, 20 bp, Artificial Sequence
  sgRNA
  NTC_2320
ggctcggtagtcgcctcgta

SEQ ID NO: 67068 - DNA, 20 bp, Artificial Sequence
  sgRNA
  NTC_2321
tctggatacgtcgcgcattt

SEQ ID NO: 67069 - DNA, 20 bp, Artificial Sequence
  sgRNA
  NTC_2322
ctacggtttgtcgcacgtcg

SEQ ID NO: 67070 - DNA, 20 bp, Artificial Sequence
  sgRNA
  NTC_2323
acgcgcagcggacgtatatc

SEQ ID NO: 67071 - DNA, 20 bp, Artificial Sequence
  sgRNA
  NTC_2324
tttgcaacgacgtccgaaaa

SEQ ID NO: 67072 - DNA, 20 bp, Artificial Sequence
  sgRNA
  NTC_2325
ggtctaggtgtacttcgtat

SEQ ID NO: 67073 - DNA, 20 bp, Artificial Sequence
  sgRNA
  NTC_2326
gcacgaacgtcgccatacgt

SEQ ID NO: 67074 - DNA, 20 bp, Artificial Sequence
  sgRNA
  NTC_2327
cgtagaagatgttcgcgtcg

SEQ ID NO: 67075 - DNA, 20 bp, Artificial Sequence
  sgRNA
  NTC_2328
gagacgtgttcacgactata

SEQ ID NO: 67076 - DNA, 20 bp, Artificial Sequence
  sgRNA
  NTC_2329
atacgcacgcggatcccgag

SEQ ID NO: 67077 - DNA, 20 bp, Artificial Sequence
  sgRNA
  NTC_2330
ggcaacacgttgcgtcgcgt

SEQ ID NO: 67078 - DNA, 20 bp, Artificial Sequence
  sgRNA
  NTC_2331
aacgtgcatagtcaatccgt

SEQ ID NO: 67079 - DNA, 20 bp, Artificial Sequence
  sgRNA
  NTC_2332
cgagctgaatcactcgtgat

SEQ ID NO: 67080 - DNA, 20 bp, Artificial Sequence
  sgRNA
  NTC_2333
tataggtcgcgtattcagtc

SEQ ID NO: 67081 - DNA, 20 bp, Artificial Sequence
  sgRNA
  NTC_2334
tcacgcacgatccgagtagt

SEQ ID NO: 67082 - DNA, 20 bp, Artificial Sequence
  sgRNA
  NTC_2335
gcgcacgcattactccgact

SEQ ID NO: 67083 - DNA, 20 bp, Artificial Sequence
  sgRNA
  NTC_2336
cgttacatggaaatcgagtc

SEQ ID NO: 67084 - DNA, 20 bp, Artificial Sequence
  sgRNA
  NTC_2337
tcggggtactattaccgtat

SEQ ID NO: 67085 - DNA, 20 bp, Artificial Sequence
  sgRNA
  NTC_2338
acagtatacggcccgagtac

SEQ ID NO: 67086 - DNA, 20 bp, Artificial Sequence
  sgRNA
  NTC_2339
gcaggattggtacgcaagtc

SEQ ID NO: 67087 - DNA, 20 bp, Artificial Sequence
  sgRNA
  NTC_2340
tgtagggcggtgcgcgctac

SEQ ID NO: 67088 - DNA, 20 bp, Artificial Sequence
  sgRNA
  NTC_2341
aaatttctacgcgtcgttac

SEQ ID NO: 67089 - DNA, 20 bp, Artificial Sequence
  sgRNA
  NTC_2342
tgatgacgggcgaataagac

SEQ ID NO: 67090 - DNA, 20 bp, Artificial Sequence
  sgRNA
  NTC_2343
gtggatacactgatacgacg

SEQ ID NO: 67091 - DNA, 20 bp, Artificial Sequence
  sgRNA
  NTC_2344
ggcggacgcgtcagatgtac

SEQ ID NO: 67092 - DNA, 20 bp, Artificial Sequence
  sgRNA
  NTC_2345
atggtcatttaccccgccgt

SEQ ID NO: 67093 - DNA, 20 bp, Artificial Sequence
  sgRNA
  NTC_2346
tgcacgatagacgttctcgc

SEQ ID NO: 67094 - DNA, 20 bp, Artificial Sequence
  sgRNA
  NTC_2347
taatgcgcgcagctccgtct

SEQ ID NO: 67095 - DNA, 20 bp, Artificial Sequence
  sgRNA
  NTC_2348
catgtcggtatcccccgcga

SEQ ID NO: 67096 - DNA, 20 bp, Artificial Sequence
  sgRNA
  NTC_2349
agcgatttagcgcccgatac

SEQ ID NO: 67097 - DNA, 20 bp, Artificial Sequence
  sgRNA
  NTC_2350
tacagcagtcgacgccgcaa

SEQ ID NO: 67098 - DNA, 20 bp, Artificial Sequence
  sgRNA
  NTC_2351
cgtagcttaggtgcgaaatc

SEQ ID NO: 67099 - DNA, 20 bp, Artificial Sequence
  sgRNA
  NTC_2352
agcgctggtttacgcgcttt

SEQ ID NO: 67100 - DNA, 20 bp, Artificial Sequence
  sgRNA
  NTC_2353
atcggagcttgaaacgcaac

SEQ ID NO: 67101 - DNA, 20 bp, Artificial Sequence
  sgRNA
  NTC_2354
cgggacgtgcgttatgcgcg

SEQ ID NO: 67102 - DNA, 20 bp, Artificial Sequence
  sgRNA
  NTC_2355
gcgtcatttggactcgctac

SEQ ID NO: 67103 - DNA, 20 bp, Artificial Sequence
  sgRNA
  NTC_2356
gtaggacggggattccgacg

SEQ ID NO: 67104 - DNA, 20 bp, Artificial Sequence
  sgRNA
  NTC_2357
gaaactacggtgttcgcttg

SEQ ID NO: 67105 - DNA, 20 bp, Artificial Sequence
  sgRNA
  NTC_2358
tctttcattcgtccgaaccg

SEQ ID NO: 67106 - DNA, 20 bp, Artificial Sequence
  sgRNA
  NTC_2359
tgtgaacgatgccgtcgacg

SEQ ID NO: 67107 - DNA, 20 bp, Artificial Sequence
  sgRNA
  NTC_2360
agtatatcgtcgcctcgacc

SEQ ID NO: 67108 - DNA, 20 bp, Artificial Sequence
  sgRNA
  NTC_2361
gcgtcgatcgacgagtagag

SEQ ID NO: 67109 - DNA, 20 bp, Artificial Sequence
  sgRNA
  NTC_2362
gacggctcggaacataatat

SEQ ID NO: 67110 - DNA, 20 bp, Artificial Sequence
  sgRNA
  NTC_2363
ggataacatatgaacgattc

SEQ ID NO: 67111 - DNA, 20 bp, Artificial Sequence
  sgRNA
  NTC_2364
cggtggacactcagcgtttg

SEQ ID NO: 67112 - DNA, 20 bp, Artificial Sequence
  sgRNA
  NTC_2365
tagtgtctacaccgtcgatt

SEQ ID NO: 67113 - DNA, 20 bp, Artificial Sequence
  sgRNA
  NTC_2366
tcgatgtattaagacgcgcc

SEQ ID NO: 67114 - DNA, 20 bp, Artificial Sequence
  sgRNA
  NTC_2367
gtcgtactagtactatcgcg

SEQ ID NO: 67115 - DNA, 20 bp, Artificial Sequence
  sgRNA
  NTC_2368
cgctaaatgcggccgtcatt

SEQ ID NO: 67116 - DNA, 20 bp, Artificial Sequence
  sgRNA
  NTC_2369
tactcgcatcgcgctccgaa

SEQ ID NO: 67117 - DNA, 20 bp, Artificial Sequence
  sgRNA
  NTC_2370
acgaatctgacatcgcgcct

SEQ ID NO: 67118 - DNA, 20 bp, Artificial Sequence
  sgRNA
  NTC_2371
tcaatcataatcgcgtgcgc

SEQ ID NO: 67119 - DNA, 20 bp, Artificial Sequence
  sgRNA
  NTC_2372
ttaggcgtattctacgagct

SEQ ID NO: 67120 - DNA, 20 bp, Artificial Sequence
  sgRNA
  NTC_2373
tcgaaatgtcttactgcgac

SEQ ID NO: 67121 - DNA, 20 bp, Artificial Sequence
  sgRNA
  NTC_2374
tttgcgtcgacgcaaacgcg

SEQ ID NO: 67122 - DNA, 20 bp, Artificial Sequence
  sgRNA
  NTC_2375
tcgctcaatacgccatcgat

SEQ ID NO: 67123 - DNA, 20 bp, Artificial Sequence
  sgRNA
  NTC_2376
ggacgtcgtacgttaatact

SEQ ID NO: 67124 - DNA, 20 bp, Artificial Sequence
  sgRNA
  NTC_2377
gcgcgatattatgcgcacga

SEQ ID NO: 67125 - DNA, 20 bp, Artificial Sequence
  sgRNA
  NTC_2378
acggcgctaggccgcccata

SEQ ID NO: 67126 - DNA, 20 bp, Artificial Sequence
  sgRNA
  NTC_2379
gacgatcgtgacccgtctcc

SEQ ID NO: 67127 - DNA, 20 bp, Artificial Sequence
  sgRNA
  NTC_2380
gctgttacgactgcgaatat

SEQ ID NO: 67128 - DNA, 20 bp, Artificial Sequence
  sgRNA
  NTC_2381
catcgcgtattacaatgtcg

SEQ ID NO: 67129 - DNA, 20 bp, Artificial Sequence
  sgRNA
  NTC_2382
ggcgatagcgcgatcgattt

SEQ ID NO: 67130 - DNA, 20 bp, Artificial Sequence
  sgRNA
  NTC_2383
gactaagggcgaatcgctac

SEQ ID NO: 67131 - DNA, 20 bp, Artificial Sequence
  sgRNA
  NTC_2384
tagagtagcggtcgtaagcg

SEQ ID NO: 67132 - DNA, 20 bp, Artificial Sequence
  sgRNA
  NTC_2385
tgcgaaacaactcgaaagcg

SEQ ID NO: 67133 - DNA, 20 bp, Artificial Sequence
  sgRNA
  NTC_2386
gcggggtttgcatgacgcta

SEQ ID NO: 67134 - DNA, 20 bp, Artificial Sequence
  sgRNA
  NTC_2387
tcgacgcgcgtcaagaatcg

SEQ ID NO: 67135 - DNA, 20 bp, Artificial Sequence
  sgRNA
  NTC_2388
tagtagactcgtatcgagcg

SEQ ID NO: 67136 - DNA, 20 bp, Artificial Sequence
  sgRNA
  NTC_2389
tcggacgcggttagtttgaa

SEQ ID NO: 67137 - DNA, 20 bp, Artificial Sequence
  sgRNA
  NTC_2390
ggcggtatgtggtccgttca

SEQ ID NO: 67138 - DNA, 20 bp, Artificial Sequence
  sgRNA
  NTC_2391
ctttgcgaatcgtgacacgc

SEQ ID NO: 67139 - DNA, 20 bp, Artificial Sequence
  sgRNA
  NTC_2392
gcatagggctaccctcgcgt

SEQ ID NO: 67140 - DNA, 20 bp, Artificial Sequence
  sgRNA
  NTC_2393
cataaaagcggtgccgacgt

SEQ ID NO: 67141 - DNA, 20 bp, Artificial Sequence
  sgRNA
  NTC_2394
gtgcgcgagtaccttatcgt

SEQ ID NO: 67142 - DNA, 20 bp, Artificial Sequence
  sgRNA
  NTC_2395
acttcacagcgccacgaatg

SEQ ID NO: 67143 - DNA, 20 bp, Artificial Sequence
  sgRNA
  NTC_2396
tgcagtaagacgcccctatt

SEQ ID NO: 67144 - DNA, 20 bp, Artificial Sequence
  sgRNA
  NTC_2397
ttaaagtcgtcatgcgaccc

SEQ ID NO: 67145 - DNA, 20 bp, Artificial Sequence
  sgRNA
  NTC_2398
gtcgatgcgcgcgagttacg

SEQ ID NO: 67146 - DNA, 20 bp, Artificial Sequence
  sgRNA
  NTC_2399
attacgcgtcatcgcgaatg

SEQ ID NO: 67147 - DNA, 20 bp, Artificial Sequence
  sgRNA
  NTC_2400
gggcggacgctctataacga

SEQ ID NO: 67148 - DNA, 20 bp, Artificial Sequence
  sgRNA
  NTC_2401
tcgtacgctagctcgacatc

SEQ ID NO: 67149 - DNA, 20 bp, Artificial Sequence
  sgRNA
  NTC_2402
tcgatggtttctaccgcgat

SEQ ID NO: 67150 - DNA, 20 bp, Artificial Sequence
  sgRNA
  NTC_2403
ctttatcgcgtctttaccgc

SEQ ID NO: 67151 - DNA, 20 bp, Artificial Sequence
  sgRNA
  NTC_2404
tattgcgactcatacgcgcg

SEQ ID NO: 67152 - DNA, 20 bp, Artificial Sequence
  sgRNA
  NTC_2405
aacggtcattcacgtcgaca

SEQ ID NO: 67153 - DNA, 20 bp, Artificial Sequence
  sgRNA
  NTC_2406
gttacgatacggtgtacgat

SEQ ID NO: 67154 - DNA, 20 bp, Artificial Sequence
  sgRNA
  NTC_2407
acgtcgtgtcgaccgagcct

SEQ ID NO: 67155 - DNA, 20 bp, Artificial Sequence
  sgRNA
  NTC_2408
ctcgtcgggacgacgctcga

SEQ ID NO: 67156 - DNA, 20 bp, Artificial Sequence
  sgRNA
  NTC_2409
acaacgatgcgcgcagtgat

SEQ ID NO: 67157 - DNA, 20 bp, Artificial Sequence
  sgRNA
  NTC_2410
ttgaggtcaatcgcaccgac

SEQ ID NO: 67158 - DNA, 20 bp, Artificial Sequence
  sgRNA
  NTC_2411
ttcatcgatggctcgcgcgc

SEQ ID NO: 67159 - DNA, 20 bp, Artificial Sequence
  sgRNA
  NTC_2412
cggtagcacacgctgacata

SEQ ID NO: 67160 - DNA, 20 bp, Artificial Sequence
  sgRNA
  NTC_2413
gcataagatgcgccgcaata

SEQ ID NO: 67161 - DNA, 20 bp, Artificial Sequence
  sgRNA
  NTC_2414
ggtacgttataccgttcaat

SEQ ID NO: 67162 - DNA, 20 bp, Artificial Sequence
  sgRNA
  NTC_2415
gcgaggcggagctttacgca

SEQ ID NO: 67163 - DNA, 20 bp, Artificial Sequence
  sgRNA
  NTC_2416
ggcgctcgatcgtattacta

SEQ ID NO: 67164 - DNA, 20 bp, Artificial Sequence
  sgRNA
  NTC_2417
tgtcgacttatgttcgcgcg

SEQ ID NO: 67165 - DNA, 20 bp, Artificial Sequence
  sgRNA
  NTC_2418
gcgacgctcgtgcgcgattt

SEQ ID NO: 67166 - DNA, 20 bp, Artificial Sequence
  sgRNA
  NTC_2419
aataaggctcgccgtgttac

SEQ ID NO: 67167 - DNA, 20 bp, Artificial Sequence
  sgRNA
  NTC_2420
cggtgctacggctcgtattg

SEQ ID NO: 67168 - DNA, 20 bp, Artificial Sequence
  sgRNA
  NTC_2421
tcgctaagtgcgcccgatcc

SEQ ID NO: 67169 - DNA, 20 bp, Artificial Sequence
  sgRNA
  NTC_2422
atcgctcaggcttccacgcg

SEQ ID NO: 67170 - DNA, 20 bp, Artificial Sequence
  sgRNA
  NTC_2423
cgcttcgaactattaagcgt

SEQ ID NO: 67171 - DNA, 20 bp, Artificial Sequence
  sgRNA
  NTC_2424
gcgagctctacgaaacgtcg

SEQ ID NO: 67172 - DNA, 20 bp, Artificial Sequence
  sgRNA
  NTC_2425
cgcagttctatcgacgcttg

SEQ ID NO: 67173 - DNA, 20 bp, Artificial Sequence
  sgRNA
  NTC_2426
tgacgcgtcgtttcgttaat

SEQ ID NO: 67174 - DNA, 20 bp, Artificial Sequence
  sgRNA
  NTC_2427
tactaacggacttgtcccga

SEQ ID NO: 67175 - DNA, 20 bp, Artificial Sequence
  sgRNA
  NTC_2428
cggacgactgtacgttcacg

SEQ ID NO: 67176 - DNA, 20 bp, Artificial Sequence
  sgRNA
  NTC_2429
gcgcagacggcgcgcgatag

SEQ ID NO: 67177 - DNA, 20 bp, Artificial Sequence
  sgRNA
  NTC_2430
tgtagtgttcgagcgcgact

SEQ ID NO: 67178 - DNA, 20 bp, Artificial Sequence
  sgRNA
  NTC_2431
gttactcgtcggaaccgtag

SEQ ID NO: 67179 - DNA, 20 bp, Artificial Sequence
  sgRNA
  NTC_2432
gggtgtcttaacgctcgtac

SEQ ID NO: 67180 - DNA, 20 bp, Artificial Sequence
  sgRNA
  NTC_2433
aataatctgatacgcgatcc

SEQ ID NO: 67181 - DNA, 20 bp, Artificial Sequence
  sgRNA
  NTC_2434
tagagctttcaactacgccg

SEQ ID NO: 67182 - DNA, 20 bp, Artificial Sequence
  sgRNA
  NTC_2435
aatgtgtcatcactcgcgcg

SEQ ID NO: 67183 - DNA, 20 bp, Artificial Sequence
  sgRNA
  NTC_2436
cgtgaatatcgcacgcgaaa

SEQ ID NO: 67184 - DNA, 20 bp, Artificial Sequence
  sgRNA
  NTC_2437
ctaatagtcaagacgccgat

SEQ ID NO: 67185 - DNA, 20 bp, Artificial Sequence
  sgRNA
  NTC_2438
aatctaacgcgtccgatatg

SEQ ID NO: 67186 - DNA, 20 bp, Artificial Sequence
  sgRNA
  NTC_2439
gaaaactttcgcgtccgtcc

SEQ ID NO: 67187 - DNA, 20 bp, Artificial Sequence
  sgRNA
  NTC_2440
taaggactcgcgtcgacacc

SEQ ID NO: 67188 - DNA, 20 bp, Artificial Sequence
  sgRNA
  NTC_2441
gcaatgcaactttcgacgcg

SEQ ID NO: 67189 - DNA, 20 bp, Artificial Sequence
  sgRNA
  NTC_2442
ttagcgcgcggtgaatcgca

SEQ ID NO: 67190 - DNA, 20 bp, Artificial Sequence
  sgRNA
  NTC_2443
tcgtacagatgctcgcgact

SEQ ID NO: 67191 - DNA, 20 bp, Artificial Sequence
  sgRNA
  NTC_2444
ggcttagcgcgaccgtatgc

SEQ ID NO: 67192 - DNA, 20 bp, Artificial Sequence
  sgRNA
  NTC_2445
aactcgtgcgcgtccgctca

SEQ ID NO: 67193 - DNA, 20 bp, Artificial Sequence
  sgRNA
  NTC_2446
ggcgaatcgcgttagttaac

SEQ ID NO: 67194 - DNA, 20 bp, Artificial Sequence
  sgRNA
  NTC_2447
gcagcggctaaacgctgttc

SEQ ID NO: 67195 - DNA, 20 bp, Artificial Sequence
  sgRNA
  NTC_2448
ctttgttatggcactacgtg

SEQ ID NO: 67196 - DNA, 20 bp, Artificial Sequence
  sgRNA
  NTC_2449
gttcgtatacgcactactcc

SEQ ID NO: 67197 - DNA, 20 bp, Artificial Sequence
  sgRNA
  NTC_2450
gtagtagatcgacgaagccg

SEQ ID NO: 67198 - DNA, 20 bp, Artificial Sequence
  sgRNA
  NTC_2451
aatgcgcggttgcccgatcg

SEQ ID NO: 67199 - DNA, 20 bp, Artificial Sequence
  sgRNA
  NTC_2452
gtgtacgcaaggtgcgtcta

SEQ ID NO: 67200 - DNA, 20 bp, Artificial Sequence
  sgRNA
  NTC_2453
tggaagggcgcgcctatgtc

SEQ ID NO: 67201 - DNA, 20 bp, Artificial Sequence
  sgRNA
  NTC_2454
cgcaattgcatcgcttacgt

SEQ ID NO: 67202 - DNA, 20 bp, Artificial Sequence
  sgRNA
  NTC_2455
aagcgacgtaacgtgtctac

SEQ ID NO: 67203 - DNA, 20 bp, Artificial Sequence
  sgRNA
  NTC_2456
tcggtgcaagacaccgccgt

SEQ ID NO: 67204 - DNA, 20 bp, Artificial Sequence
  sgRNA
  NTC_2457
tcgttaaatcacatcaccct

SEQ ID NO: 67205 - DNA, 20 bp, Artificial Sequence
  sgRNA
  NTC_2458
gcggctcgggcgttgtgaat

SEQ ID NO: 67206 - DNA, 20 bp, Artificial Sequence
  sgRNA
  NTC_2459
agcggcgggtcgtccgacaa

SEQ ID NO: 67207 - DNA, 20 bp, Artificial Sequence
  sgRNA
  NTC_2460
aagttgcgacgaccgataaa

SEQ ID NO: 67208 - DNA, 20 bp, Artificial Sequence
  sgRNA
  NTC_2461
gcgaatcacactcgcgttcg

SEQ ID NO: 67209 - DNA, 20 bp, Artificial Sequence
  sgRNA
  NTC_2462
gttgaacgcggtcagcgatt

SEQ ID NO: 67210 - DNA, 20 bp, Artificial Sequence
  sgRNA
  NTC_2463
actctcacgtagacgtcgac

SEQ ID NO: 67211 - DNA, 20 bp, Artificial Sequence
  sgRNA
  NTC_2464
ggtagggtgagtaccgattg

SEQ ID NO: 67212 - DNA, 20 bp, Artificial Sequence
  sgRNA
  NTC_2465
gctcgatcatgacacgatga

SEQ ID NO: 67213 - DNA, 20 bp, Artificial Sequence
  sgRNA
  NTC_2466
aatggaacgatcgacgtaat

SEQ ID NO: 67214 - DNA, 20 bp, Artificial Sequence
  sgRNA
  NTC_2467
gggaaacgtgcgccgaagat

SEQ ID NO: 67215 - DNA, 20 bp, Artificial Sequence
  sgRNA
  NTC_2468
gcttcgcgcgattcatgttc

SEQ ID NO: 67216 - DNA, 20 bp, Artificial Sequence
  sgRNA
  NTC_2469
tgacggtcgacgcgactaga

SEQ ID NO: 67217 - DNA, 20 bp, Artificial Sequence
  sgRNA
  NTC_2470
gcgaaagagtgtgtcgattg

SEQ ID NO: 67218 - DNA, 20 bp, Artificial Sequence
  sgRNA
  NTC_2471
ttattaacgcgcatcgagcg

SEQ ID NO: 67219 - DNA, 20 bp, Artificial Sequence
  sgRNA
  NTC_2472
ggctcgatgctcgcgctaaa

SEQ ID NO: 67220 - DNA, 20 bp, Artificial Sequence
  sgRNA
  NTC_2473
gtcgcgtagcgtacacacgc

SEQ ID NO: 67221 - DNA, 20 bp, Artificial Sequence
  sgRNA
  NTC_2474
actttacgcgtcatccagat

SEQ ID NO: 67222 - DNA, 20 bp, Artificial Sequence
  sgRNA
  NTC_2475
acacagttatgcgacgataa

SEQ ID NO: 67223 - DNA, 20 bp, Artificial Sequence
  sgRNA
  NTC_2476
cgcactagtacgtcgagccg

SEQ ID NO: 67224 - DNA, 20 bp, Artificial Sequence
  sgRNA
  NTC_2477
gtttcgaaacggtgcgccaa

SEQ ID NO: 67225 - DNA, 20 bp, Artificial Sequence
  sgRNA
  NTC_2478
agtaggcgcgcgacgcactt

SEQ ID NO: 67226 - DNA, 20 bp, Artificial Sequence
  sgRNA
  NTC_2479
ggttcagctaaatacgaagt

SEQ ID NO: 67227 - DNA, 20 bp, Artificial Sequence
  sgRNA
  NTC_2480
ctacaggtcgttccgcgcgc

SEQ ID NO: 67228 - DNA, 20 bp, Artificial Sequence
  sgRNA
  NTC_2481
cgattatggaggcgtacgaa

SEQ ID NO: 67229 - DNA, 20 bp, Artificial Sequence
  sgRNA
  NTC_2482
acgtcggttcgaataatatc

SEQ ID NO: 67230 - DNA, 20 bp, Artificial Sequence
  sgRNA
  NTC_2483
acgcggtaagttcgcgacga

SEQ ID NO: 67231 - DNA, 20 bp, Artificial Sequence
  sgRNA
  NTC_2484
cgggttaggcgtcgattaat

SEQ ID NO: 67232 - DNA, 20 bp, Artificial Sequence
  sgRNA
  NTC_2485
tgttgcgggttcgcgcaact

SEQ ID NO: 67233 - DNA, 20 bp, Artificial Sequence
  sgRNA
  NTC_2486
ggacaaggtacgctcgataa

SEQ ID NO: 67234 - DNA, 20 bp, Artificial Sequence
  sgRNA
  NTC_2487
caacaagtgcgatcgatagt

SEQ ID NO: 67235 - DNA, 20 bp, Artificial Sequence
  sgRNA
  NTC_2488
tacgcgtttacacctagatc

SEQ ID NO: 67236 - DNA, 20 bp, Artificial Sequence
  sgRNA
  NTC_2489
actagataggcgattgcccg

SEQ ID NO: 67237 - DNA, 20 bp, Artificial Sequence
  sgRNA
  NTC_2490
tatcggcgtcgcaactgctt

SEQ ID NO: 67238 - DNA, 20 bp, Artificial Sequence
  sgRNA
  NTC_2491
cgtcgatatgtcgctaacgt

SEQ ID NO: 67239 - DNA, 20 bp, Artificial Sequence
  sgRNA
  NTC_2492
gcggttaacagccgcgttag

SEQ ID NO: 67240 - DNA, 20 bp, Artificial Sequence
  sgRNA
  NTC_2493
cgacgcgaggatccgttagt

SEQ ID NO: 67241 - DNA, 20 bp, Artificial Sequence
  sgRNA
  NTC_2494
acgtatcgttcgctcccgtt

SEQ ID NO: 67242 - DNA, 20 bp, Artificial Sequence
  sgRNA
  NTC_2495
gcgcacgcgaacctttcgtg

SEQ ID NO: 67243 - DNA, 20 bp, Artificial Sequence
  sgRNA
  NTC_2496
catgcgacaatccgaacgta

SEQ ID NO: 67244 - DNA, 20 bp, Artificial Sequence
  sgRNA
  NTC_2497
cttattggggatccgacgaa

SEQ ID NO: 67245 - DNA, 20 bp, Artificial Sequence
  sgRNA
  NTC_2498
gcgcttgagcgcgatcttac

SEQ ID NO: 67246 - DNA, 20 bp, Artificial Sequence
  sgRNA
  NTC_2499
aagcaactaagcgtccgcgt

SEQ ID NO: 67247 - DNA, 20 bp, Artificial Sequence
  sgRNA
  NTC_2500
atcagtattagcgctcgcga

SEQ ID NO: 67248 - DNA, 20 bp, Artificial Sequence
  sgRNA
  NTC_2501
ggcttcacgaaacgttacgc

SEQ ID NO: 67249 - DNA, 20 bp, Artificial Sequence
  sgRNA
  NTC_2502
gggcgaaattcgtcaatacg

SEQ ID NO: 67250 - DNA, 20 bp, Artificial Sequence
  sgRNA
  NTC_2503
cataattgcgctcgtcgatt

SEQ ID NO: 67251 - DNA, 20 bp, Artificial Sequence
  sgRNA
  NTC_2504
tcgcgtaatatgaacgtcgt

SEQ ID NO: 67252 - DNA, 20 bp, Artificial Sequence
  sgRNA
  NTC_2505
ctatgcggtcacacgatcgt

SEQ ID NO: 67253 - DNA, 20 bp, Artificial Sequence
  sgRNA
  NTC_2506
tagaggatgatcaccgcata

SEQ ID NO: 67254 - DNA, 20 bp, Artificial Sequence
  sgRNA
  NTC_2507
ttcggaaatcttaccgtgcc

SEQ ID NO: 67255 - DNA, 20 bp, Artificial Sequence
  sgRNA
  NTC_2508
cggtatctcgatgtcgagtg

SEQ ID NO: 67256 - DNA, 20 bp, Artificial Sequence
  sgRNA
  NTC_2509
gtggatgacgcgtgcgctac

SEQ ID NO: 67257 - DNA, 20 bp, Artificial Sequence
  sgRNA
  NTC_2510
gcgttagtgatcgaatcgcg

SEQ ID NO: 67258 - DNA, 20 bp, Artificial Sequence
  sgRNA
  NTC_2511
tcaacaacgcgtctcgttaa

SEQ ID NO: 67259 - DNA, 20 bp, Artificial Sequence
  sgRNA
  NTC_2512
gcggtcatatacctaccgta

SEQ ID NO: 67260 - DNA, 20 bp, Artificial Sequence
  sgRNA
  NTC_2513
tcggcgaactggtttcgttg

SEQ ID NO: 67261 - DNA, 20 bp, Artificial Sequence
  sgRNA
  NTC_2514
tcgaggcgcacagttaatca

SEQ ID NO: 67262 - DNA, 20 bp, Artificial Sequence
  sgRNA
  NTC_2515
tgggtagcgtacgcgaccat

SEQ ID NO: 67263 - DNA, 20 bp, Artificial Sequence
  sgRNA
  NTC_2516
acgaaggtcgcgcttacgcc

SEQ ID NO: 67264 - DNA, 20 bp, Artificial Sequence
  sgRNA
  NTC_2517
actattgtggttactcgcga

SEQ ID NO: 67265 - DNA, 20 bp, Artificial Sequence
  sgRNA
  NTC_2518
tactgtcgacgcaccctata

SEQ ID NO: 67266 - DNA, 20 bp, Artificial Sequence
  sgRNA
  NTC_2519
tcatctcatctcatcgctcg

SEQ ID NO: 67267 - DNA, 20 bp, Artificial Sequence
  sgRNA
  NTC_2520
ttacaatcgtaatcgcgctg

SEQ ID NO: 67268 - DNA, 20 bp, Artificial Sequence
  sgRNA
  NTC_2521
gcaacgttcgcgcctattat

SEQ ID NO: 67269 - DNA, 20 bp, Artificial Sequence
  sgRNA
  NTC_2522
ttcacaactacgtctcgagt

SEQ ID NO: 67270 - DNA, 20 bp, Artificial Sequence
  sgRNA
  NTC_2523
tcacgggtggcatacgctcg

SEQ ID NO: 67271 - DNA, 20 bp, Artificial Sequence
  sgRNA
  NTC_2524
tcggtcgggaaatcgtcgca

SEQ ID NO: 67272 - DNA, 20 bp, Artificial Sequence
  sgRNA
  NTC_2525
ggcgctcggcaatgaacgtt

SEQ ID NO: 67273 - DNA, 20 bp, Artificial Sequence
  sgRNA
  NTC_2526
gaaatcgattcgaaccgaat

SEQ ID NO: 67274 - DNA, 20 bp, Artificial Sequence
  sgRNA
  NTC_2527
agtttagcattccgcgtatg

SEQ ID NO: 67275 - DNA, 20 bp, Artificial Sequence
  sgRNA
  NTC_2528
ggtagtggagcgatcgtagt

SEQ ID NO: 67276 - DNA, 20 bp, Artificial Sequence
  sgRNA
  NTC_2529
tcggatcgtgtaaacgctct

SEQ ID NO: 67277 - DNA, 20 bp, Artificial Sequence
  sgRNA
  NTC_2530
cgctcggcgagtaccaacat

SEQ ID NO: 67278 - DNA, 20 bp, Artificial Sequence
  sgRNA
  NTC_2531
tttgcgcgattcctcgagag

SEQ ID NO: 67279 - DNA, 20 bp, Artificial Sequence
  sgRNA
  NTC_2532
cgaaacgctgcgtatcgtcg

SEQ ID NO: 67280 - DNA, 20 bp, Artificial Sequence
  sgRNA
  NTC_2533
aaacggtattgtcgaaccga

SEQ ID NO: 67281 - DNA, 20 bp, Artificial Sequence
  sgRNA
  NTC_2534
cgtcgacacacgcgtgacga

SEQ ID NO: 67282 - DNA, 20 bp, Artificial Sequence
  sgRNA
  NTC_2535
gacgtcgtaaattaccgtta

SEQ ID NO: 67283 - DNA, 20 bp, Artificial Sequence
  sgRNA
  NTC_2536
attctcgaggagtttcgatc

SEQ ID NO: 67284 - DNA, 20 bp, Artificial Sequence
  sgRNA
  NTC_2537
tcgttacatactcctcgtaa

SEQ ID NO: 67285 - DNA, 20 bp, Artificial Sequence
  sgRNA
  NTC_2538
ggacaacttatcgcgcctgc

SEQ ID NO: 67286 - DNA, 20 bp, Artificial Sequence
  sgRNA
  NTC_2539
tgtcgattgcttctacgacg

SEQ ID NO: 67287 - DNA, 20 bp, Artificial Sequence
  sgRNA
  NTC_2540
acttaagcggcgacctgcta

SEQ ID NO: 67288 - DNA, 20 bp, Artificial Sequence
  sgRNA
  NTC_2541
acgggtagggcactccgtcg

SEQ ID NO: 67289 - DNA, 20 bp, Artificial Sequence
  sgRNA
  NTC_2542
ttaggtctcgatcgcgtaag

SEQ ID NO: 67290 - DNA, 20 bp, Artificial Sequence
  sgRNA
  NTC_2543
tcgatactaacacgtgcgag

SEQ ID NO: 67291 - DNA, 20 bp, Artificial Sequence
  sgRNA
  NTC_2544
ggtcaacgcgcgatcacgcg

SEQ ID NO: 67292 - DNA, 20 bp, Artificial Sequence
  sgRNA
  NTC_2545
cgcacgtctgcgcgtcgact

SEQ ID NO: 67293 - DNA, 20 bp, Artificial Sequence
  sgRNA
  NTC_2546
tgttcgtactcgccgttcgc

SEQ ID NO: 67294 - DNA, 20 bp, Artificial Sequence
  sgRNA
  NTC_2547
tcggtgtgtcgacagcgtcc

SEQ ID NO: 67295 - DNA, 20 bp, Artificial Sequence
  sgRNA
  NTC_2548
tgttacattcgcgcgacagt

SEQ ID NO: 67296 - DNA, 20 bp, Artificial Sequence
  sgRNA
  NTC_2549
ttagtgacgataccctaccg

SEQ ID NO: 67297 - DNA, 20 bp, Artificial Sequence
  sgRNA
  NTC_2550
ctctaaacgttagccgcgta

SEQ ID NO: 67298 - DNA, 20 bp, Artificial Sequence
  sgRNA
  NTC_2551
tgtcagactcacgcgaatcg

SEQ ID NO: 67299 - DNA, 20 bp, Artificial Sequence
  sgRNA
  NTC_2552
aggcgtcttatcgcgcacca

SEQ ID NO: 67300 - DNA, 20 bp, Artificial Sequence
  sgRNA
  NTC_2553
aaggtcgttcggcccatgcg

SEQ ID NO: 67301 - DNA, 20 bp, Artificial Sequence
  sgRNA
  NTC_2554
ctgacagacgcgccccgtaa

SEQ ID NO: 67302 - DNA, 20 bp, Artificial Sequence
  sgRNA
  NTC_2555
attgcggctggccgcttacg

SEQ ID NO: 67303 - DNA, 20 bp, Artificial Sequence
  sgRNA
  NTC_2556
tttcgagatgcattgacgcc

SEQ ID NO: 67304 - DNA, 20 bp, Artificial Sequence
  sgRNA
  NTC_2557
tagcgtttacggtgcgattc

SEQ ID NO: 67305 - DNA, 20 bp, Artificial Sequence
  sgRNA
  NTC_2558
gcgcgtgggtttcgatcatt

SEQ ID NO: 67306 - DNA, 20 bp, Artificial Sequence
  sgRNA
  NTC_2559
tggttcactcgtcgcgtgtg

SEQ ID NO: 67307 - DNA, 20 bp, Artificial Sequence
  sgRNA
  NTC_2560
ttagctacgattccgacgtt

SEQ ID NO: 67308 - DNA, 20 bp, Artificial Sequence
  sgRNA
  NTC_2561
tgatattgtggcaccgcctc

SEQ ID NO: 67309 - DNA, 20 bp, Artificial Sequence
  sgRNA
  NTC_2562
cgtaatcagcggccgtcttt

SEQ ID NO: 67310 - DNA, 20 bp, Artificial Sequence
  sgRNA
  NTC_2563
tggttagtacgacaacgccg

SEQ ID NO: 67311 - DNA, 20 bp, Artificial Sequence
  sgRNA
  NTC_2564
ggggtcggtcttaacgtacg

SEQ ID NO: 67312 - DNA, 20 bp, Artificial Sequence
  sgRNA
  NTC_2565
catggtacgtaccgcaatcg

SEQ ID NO: 67313 - DNA, 20 bp, Artificial Sequence
  sgRNA
  NTC_2566
cgcgcaactgtcgtgcgctt

SEQ ID NO: 67314 - DNA, 20 bp, Artificial Sequence
  sgRNA
  NTC_2567
gctcttggacgtcgcaccgt

SEQ ID NO: 67315 - DNA, 20 bp, Artificial Sequence
  sgRNA
  NTC_2568
tagatatcgcacgttatatc

SEQ ID NO: 67316 - DNA, 20 bp, Artificial Sequence
  sgRNA
  NTC_2569
acggaactttgtcgccgtat

SEQ ID NO: 67317 - DNA, 20 bp, Artificial Sequence
  sgRNA
  NTC_2570
caatcattatgctacgtgcg

SEQ ID NO: 67318 - DNA, 20 bp, Artificial Sequence
  sgRNA
  NTC_2571
cgggagcgaagtctgcgtaa

SEQ ID NO: 67319 - DNA, 20 bp, Artificial Sequence
  sgRNA
  NTC_2572
tacagcgagttcctgacgtc

SEQ ID NO: 67320 - DNA, 20 bp, Artificial Sequence
  sgRNA
  NTC_2573
gcatgagtctcgcgtcgaac

SEQ ID NO: 67321 - DNA, 20 bp, Artificial Sequence
  sgRNA
  NTC_2574
tgtgcgcgcggcgtagcgaa

SEQ ID NO: 67322 - DNA, 20 bp, Artificial Sequence
  sgRNA
  NTC_2575
cgagatacgcgtaacgcgct

SEQ ID NO: 67323 - DNA, 20 bp, Artificial Sequence
  sgRNA
  NTC_2576
cggcggggtggacgtacttt

SEQ ID NO: 67324 - DNA, 20 bp, Artificial Sequence
  sgRNA
  NTC_2577
ggtaggtcgtcgcttgaatc

SEQ ID NO: 67325 - DNA, 20 bp, Artificial Sequence
  sgRNA
  NTC_2578
ggctgcgggcgttacatcga

SEQ ID NO: 67326 - DNA, 20 bp, Artificial Sequence
  sgRNA
  NTC_2579
aggcataggggcgcgtacca

SEQ ID NO: 67327 - DNA, 20 bp, Artificial Sequence
  sgRNA
  NTC_2580
aacgtggctcgcatccgaca

SEQ ID NO: 67328 - DNA, 20 bp, Artificial Sequence
  sgRNA
  NTC_2581
acgcagtgatcgagcgatgt

SEQ ID NO: 67329 - DNA, 20 bp, Artificial Sequence
  sgRNA
  NTC_2582
agaacggcgaacttatgcac

SEQ ID NO: 67330 - DNA, 20 bp, Artificial Sequence
  sgRNA
  NTC_2583
tcggcacgactacttatcga

SEQ ID NO: 67331 - DNA, 20 bp, Artificial Sequence
  sgRNA
  NTC_2584
ggatcacgcgcgagtagtac

SEQ ID NO: 67332 - DNA, 20 bp, Artificial Sequence
  sgRNA
  NTC_2585
gcgtctaacgcaccgcttag

SEQ ID NO: 67333 - DNA, 20 bp, Artificial Sequence
  sgRNA
  NTC_2586
tttggcggtacgcctcgtcc

SEQ ID NO: 67334 - DNA, 20 bp, Artificial Sequence
  sgRNA
  NTC_2587
taggtttacacgtacgacca

SEQ ID NO: 67335 - DNA, 20 bp, Artificial Sequence
  sgRNA
  NTC_2588
cttgcgcaatctcgtccaat

SEQ ID NO: 67336 - DNA, 20 bp, Artificial Sequence
  sgRNA
  NTC_2589
ggggcgcatagccgtaagac

SEQ ID NO: 67337 - DNA, 20 bp, Artificial Sequence
  sgRNA
  NTC_2590
cgcatacacgagcgctgtat

SEQ ID NO: 67338 - DNA, 20 bp, Artificial Sequence
  sgRNA
  NTC_2591
tatcgcgcggaccgagattg

SEQ ID NO: 67339 - DNA, 20 bp, Artificial Sequence
  sgRNA
  NTC_2592
ctaacgtggtatgacgttct

SEQ ID NO: 67340 - DNA, 20 bp, Artificial Sequence
  sgRNA
  NTC_2593
gtggctacgattgctgcgcg

SEQ ID NO: 67341 - DNA, 20 bp, Artificial Sequence
  sgRNA
  NTC_2594
cggcgggcttcattatttcg

SEQ ID NO: 67342 - DNA, 20 bp, Artificial Sequence
  sgRNA
  NTC_2595
attcgatcgcaacgatgtag

SEQ ID NO: 67343 - DNA, 20 bp, Artificial Sequence
  sgRNA
  NTC_2596
ctacgataggcgccctatta

SEQ ID NO: 67344 - DNA, 20 bp, Artificial Sequence
  sgRNA
  NTC_2597
aactggcactacgcgagtac

SEQ ID NO: 67345 - DNA, 20 bp, Artificial Sequence
  sgRNA
  NTC_2598
gcgtaatggttcgagcttcg

SEQ ID NO: 67346 - DNA, 20 bp, Artificial Sequence
  sgRNA
  NTC_2599
cgaagatatcgtactgcgcc

SEQ ID NO: 67347 - DNA, 20 bp, Artificial Sequence
  sgRNA
  NTC_2600
aacgatacggaatcttcgac

SEQ ID NO: 67348 - DNA, 20 bp, Artificial Sequence
  sgRNA
  NTC_2601
tcgtggttcgaccttaccgc

SEQ ID NO: 67349 - DNA, 20 bp, Artificial Sequence
  sgRNA
  NTC_2602
cgagcgcactgaacgattac

SEQ ID NO: 67350 - DNA, 20 bp, Artificial Sequence
  sgRNA
  NTC_2603
gctggcgggtgcataacgag

SEQ ID NO: 67351 - DNA, 20 bp, Artificial Sequence
  sgRNA
  NTC_2604
cggcgatcggcgtcgtttgc

SEQ ID NO: 67352 - DNA, 20 bp, Artificial Sequence
  sgRNA
  NTC_2605
cggacattcgggaattccgc

SEQ ID NO: 67353 - DNA, 20 bp, Artificial Sequence
  sgRNA
  NTC_2606
tatcagaactacgaccgtac

SEQ ID NO: 67354 - DNA, 20 bp, Artificial Sequence
  sgRNA
  NTC_2607
gtgacgtacatcgcactcac

SEQ ID NO: 67355 - DNA, 20 bp, Artificial Sequence
  sgRNA
  NTC_2608
acgtcagcgtatatcgcgtt

SEQ ID NO: 67356 - DNA, 20 bp, Artificial Sequence
  sgRNA
  NTC_2609
ggacgggataacttcgacga

SEQ ID NO: 67357 - DNA, 20 bp, Artificial Sequence
  sgRNA
  NTC_2610
cacgcactgatacgtcaaag

SEQ ID NO: 67358 - DNA, 20 bp, Artificial Sequence
  sgRNA
  NTC_2611
cgctgggcgatattccgtaa

SEQ ID NO: 67359 - DNA, 20 bp, Artificial Sequence
  sgRNA
  NTC_2612
ggtgacggtacgactctcgt

SEQ ID NO: 67360 - DNA, 20 bp, Artificial Sequence
  sgRNA
  NTC_2613
tagcatcggtggcgttgtat

SEQ ID NO: 67361 - DNA, 20 bp, Artificial Sequence
  sgRNA
  NTC_2614
aacgcgatgcttacgcctct

SEQ ID NO: 67362 - DNA, 20 bp, Artificial Sequence
  sgRNA
  NTC_2615
acaatatcgtcgctctaatc

SEQ ID NO: 67363 - DNA, 20 bp, Artificial Sequence
  sgRNA
  NTC_2616
ttcgtctaacgtatcgtcgc

SEQ ID NO: 67364 - DNA, 20 bp, Artificial Sequence
  sgRNA
  NTC_2617
cggtaggcttacgttaccct

SEQ ID NO: 67365 - DNA, 20 bp, Artificial Sequence
  sgRNA
  NTC_2618
gagcatgatcgcaccgatat

SEQ ID NO: 67366 - DNA, 20 bp, Artificial Sequence
  sgRNA
  NTC_2619
ttgcgattaacgtatcgtgt

SEQ ID NO: 67367 - DNA, 20 bp, Artificial Sequence
  sgRNA
  NTC_2620
acttaacgaacgtccgtccg

SEQ ID NO: 67368 - DNA, 20 bp, Artificial Sequence
  sgRNA
  NTC_2621
ggctacatcgtgtatcgtac

SEQ ID NO: 67369 - DNA, 20 bp, Artificial Sequence
  sgRNA
  NTC_2622
tcgacgacggctaccccaat

SEQ ID NO: 67370 - DNA, 20 bp, Artificial Sequence
  sgRNA
  NTC_2623
caaagtcgaaaaccgtcccc

SEQ ID NO: 67371 - DNA, 20 bp, Artificial Sequence
  sgRNA
  NTC_2624
cgttacgttcaccccgaccg

SEQ ID NO: 67372 - DNA, 20 bp, Artificial Sequence
  sgRNA
  NTC_2625
gaggtgcaatacccacgacg

SEQ ID NO: 67373 - DNA, 20 bp, Artificial Sequence
  sgRNA
  NTC_2626
gcggtaaagcgttgcgtgac

SEQ ID NO: 67374 - DNA, 20 bp, Artificial Sequence
  sgRNA
  NTC_2627
acgcgcatggtccgttctac

SEQ ID NO: 67375 - DNA, 20 bp, Artificial Sequence
  sgRNA
  NTC_2628
gggtgctctgtactcgcgaa

SEQ ID NO: 67376 - DNA, 20 bp, Artificial Sequence
  sgRNA
  NTC_2629
cagtggcgagtgcgttactc

SEQ ID NO: 67377 - DNA, 20 bp, Artificial Sequence
  sgRNA
  NTC_2630
aaaactctcgcgaacccgtg

SEQ ID NO: 67378 - DNA, 20 bp, Artificial Sequence
  sgRNA
  NTC_2631
gtgaggcttcgccgaactat

SEQ ID NO: 67379 - DNA, 20 bp, Artificial Sequence
  sgRNA
  NTC_2632
gacgtagtgaaacccgattt

SEQ ID NO: 67380 - DNA, 20 bp, Artificial Sequence
  sgRNA
  NTC_2633
gatcgtcattgcactaattc

SEQ ID NO: 67381 - DNA, 20 bp, Artificial Sequence
  sgRNA
  NTC_2634
acgcatcgtcgccgatattt

SEQ ID NO: 67382 - DNA, 20 bp, Artificial Sequence
  sgRNA
  NTC_2635
aaacggatttagcgccgctt

SEQ ID NO: 67383 - DNA, 20 bp, Artificial Sequence
  sgRNA
  NTC_2636
atggacgaacttcgcccgcg

SEQ ID NO: 67384 - DNA, 20 bp, Artificial Sequence
  sgRNA
  NTC_2637
attgaatcgtggatcgcgac

SEQ ID NO: 67385 - DNA, 20 bp, Artificial Sequence
  sgRNA
  NTC_2638
acgcaaaaagtatgcgtacg

SEQ ID NO: 67386 - DNA, 20 bp, Artificial Sequence
  sgRNA
  NTC_2639
atagcgttcgcgcgtgataa

SEQ ID NO: 67387 - DNA, 20 bp, Artificial Sequence
  sgRNA
  NTC_2640
cgtacaataggcccgctaac

SEQ ID NO: 67388 - DNA, 20 bp, Artificial Sequence
  sgRNA
  NTC_2641
acgcataggctcgtcgtcac

SEQ ID NO: 67389 - DNA, 20 bp, Artificial Sequence
  sgRNA
  NTC_2642
aaactacggctcgtctcacc

SEQ ID NO: 67390 - DNA, 20 bp, Artificial Sequence
  sgRNA
  NTC_2643
tgcgtatcgtgccatacaat

SEQ ID NO: 67391 - DNA, 20 bp, Artificial Sequence
  sgRNA
  NTC_2644
gagtacgaatctctcgtaac

SEQ ID NO: 67392 - DNA, 20 bp, Artificial Sequence
  sgRNA
  NTC_2645
acggtaactcgccgacgatg

SEQ ID NO: 67393 - DNA, 20 bp, Artificial Sequence
  sgRNA
  NTC_2646
tggtgactaacactcgaccg

SEQ ID NO: 67394 - DNA, 20 bp, Artificial Sequence
  sgRNA
  NTC_2647
ttgtaacttacttgcgccgt

SEQ ID NO: 67395 - DNA, 20 bp, Artificial Sequence
  sgRNA
  NTC_2648
tcacgctcattgtccgaacg

SEQ ID NO: 67396 - DNA, 20 bp, Artificial Sequence
  sgRNA
  NTC_2649
tacgcattcgggcgatacgt

SEQ ID NO: 67397 - DNA, 20 bp, Artificial Sequence
  sgRNA
  NTC_2650
gacgaatgatcgtacccctt

SEQ ID NO: 67398 - DNA, 20 bp, Artificial Sequence
  sgRNA
  NTC_2651
gttgcgcgcgttgcgcgaac

SEQ ID NO: 67399 - DNA, 20 bp, Artificial Sequence
  sgRNA
  NTC_2652
acaactcgggcgaccgtcga

SEQ ID NO: 67400 - DNA, 20 bp, Artificial Sequence
  sgRNA
  NTC_2653
gtcgaacggtacgcatacca

SEQ ID NO: 67401 - DNA, 20 bp, Artificial Sequence
  sgRNA
  NTC_2654
acgtgggcagttcgcctata

SEQ ID NO: 67402 - DNA, 20 bp, Artificial Sequence
  sgRNA
  NTC_2655
gttggattggcgtagcaccg

SEQ ID NO: 67403 - DNA, 20 bp, Artificial Sequence
  sgRNA
  NTC_2656
cgctatgaacagtacgatcc

SEQ ID NO: 67404 - DNA, 20 bp, Artificial Sequence
  sgRNA
  NTC_2657
atgcgcgggtactaaagtcg

SEQ ID NO: 67405 - DNA, 20 bp, Artificial Sequence
  sgRNA
  NTC_2658
ggaatttcgtcgccccccgc

SEQ ID NO: 67406 - DNA, 20 bp, Artificial Sequence
  sgRNA
  NTC_2659
ttagggcagtatcgtcgctt

SEQ ID NO: 67407 - DNA, 20 bp, Artificial Sequence
  sgRNA
  NTC_2660
cggacattatacgaccgtta

SEQ ID NO: 67408 - DNA, 20 bp, Artificial Sequence
  sgRNA
  NTC_2661
ctcaaacatactcgaacgat

SEQ ID NO: 67409 - DNA, 20 bp, Artificial Sequence
  sgRNA
  NTC_2662
agaggggggacgttcgcgct

SEQ ID NO: 67410 - DNA, 20 bp, Artificial Sequence
  sgRNA
  NTC_2663
cgacgcttaggccccgccag

SEQ ID NO: 67411 - DNA, 20 bp, Artificial Sequence
  sgRNA
  NTC_2664
agcaagcgatactacgcgcc

SEQ ID NO: 67412 - DNA, 20 bp, Artificial Sequence
  sgRNA
  NTC_2665
gctacgtgtggtatcgtcat

SEQ ID NO: 67413 - DNA, 20 bp, Artificial Sequence
  sgRNA
  NTC_2666
gtttcgcgcgctacgcaatc

SEQ ID NO: 67414 - DNA, 20 bp, Artificial Sequence
  sgRNA
  NTC_2667
cacaacggcgtgtcgtctat

SEQ ID NO: 67415 - DNA, 20 bp, Artificial Sequence
  sgRNA
  NTC_2668
agaatgcgcacgcaatcgac

SEQ ID NO: 67416 - DNA, 20 bp, Artificial Sequence
  sgRNA
  NTC_2669
ggtatagcggcgaaccgact

SEQ ID NO: 67417 - DNA, 20 bp, Artificial Sequence
  sgRNA
  NTC_2670
ggacgtgcggtacgcgagct

SEQ ID NO: 67418 - DNA, 20 bp, Artificial Sequence
  sgRNA
  NTC_2671
agctcgctaacgccgacttc

SEQ ID NO: 67419 - DNA, 20 bp, Artificial Sequence
  sgRNA
  NTC_2672
gggatcgcggaccttacatc

SEQ ID NO: 67420 - DNA, 20 bp, Artificial Sequence
  sgRNA
  NTC_2673
ggcaggacgctcgcccgtta

SEQ ID NO: 67421 - DNA, 20 bp, Artificial Sequence
  sgRNA
  NTC_2674
gttgcgcgcaatgtcgcttc

SEQ ID NO: 67422 - DNA, 20 bp, Artificial Sequence
  sgRNA
  NTC_2675
cactacggacggcctatcgc

SEQ ID NO: 67423 - DNA, 20 bp, Artificial Sequence
  sgRNA
  NTC_2676
tgcgacgcgtatgatccgag

SEQ ID NO: 67424 - DNA, 20 bp, Artificial Sequence
  sgRNA
  NTC_2677
catcgaatacggactacgtc

SEQ ID NO: 67425 - DNA, 20 bp, Artificial Sequence
  sgRNA
  NTC_2678
cgatcttaagcttcgcgccg

SEQ ID NO: 67426 - DNA, 20 bp, Artificial Sequence
  sgRNA
  NTC_2679
tagaacaagactagcgattc

SEQ ID NO: 67427 - DNA, 20 bp, Artificial Sequence
  sgRNA
  NTC_2680
agtatacgagtgcgcgtaac

SEQ ID NO: 67428 - DNA, 20 bp, Artificial Sequence
  sgRNA
  NTC_2681
attagttcgcgcctcgacgt

SEQ ID NO: 67429 - DNA, 20 bp, Artificial Sequence
  sgRNA
  NTC_2682
gcttggggacattgcgccat

SEQ ID NO: 67430 - DNA, 20 bp, Artificial Sequence
  sgRNA
  NTC_2683
gggcgttcgcgtgacgtacc

SEQ ID NO: 67431 - DNA, 20 bp, Artificial Sequence
  sgRNA
  NTC_2684
cgttgcagtattacgcccga

SEQ ID NO: 67432 - DNA, 20 bp, Artificial Sequence
  sgRNA
  NTC_2685
ggctagcgagttagcgatgc

SEQ ID NO: 67433 - DNA, 20 bp, Artificial Sequence
  sgRNA
  NTC_2686
taagagggtagcgccgttat

SEQ ID NO: 67434 - DNA, 20 bp, Artificial Sequence
  sgRNA
  NTC_2687
taacggacgaggctcgcgtt

SEQ ID NO: 67435 - DNA, 20 bp, Artificial Sequence
  sgRNA
  NTC_2688
tcggttcgacgtcttagcgc

SEQ ID NO: 67436 - DNA, 20 bp, Artificial Sequence
  sgRNA
  NTC_2689
tggatacactcgtacgagtg

SEQ ID NO: 67437 - DNA, 20 bp, Artificial Sequence
  sgRNA
  NTC_2690
aatacggtaaatcgcgaact

SEQ ID NO: 67438 - DNA, 20 bp, Artificial Sequence
  sgRNA
  NTC_2691
aattaacggcatcaatcgta

SEQ ID NO: 67439 - DNA, 20 bp, Artificial Sequence
  sgRNA
  NTC_2692
tgatagacgcgcgtcttaga

SEQ ID NO: 67440 - DNA, 20 bp, Artificial Sequence
  sgRNA
  NTC_2693
tggtacatcgcgctgccgtc

SEQ ID NO: 67441 - DNA, 20 bp, Artificial Sequence
  sgRNA
  NTC_2694
tagtagatggtccccgtgct

SEQ ID NO: 67442 - DNA, 20 bp, Artificial Sequence
  sgRNA
  NTC_2695
gttctctcgcgcgtctatcg

SEQ ID NO: 67443 - DNA, 20 bp, Artificial Sequence
  sgRNA
  NTC_2696
ctcgtttaacgaagcgtttg

SEQ ID NO: 67444 - DNA, 20 bp, Artificial Sequence
  sgRNA
  NTC_2697
gtctagcttcgagttacgcg

SEQ ID NO: 67445 - DNA, 20 bp, Artificial Sequence
  sgRNA
  NTC_2698
gtagacgcggggcgacagta

SEQ ID NO: 67446 - DNA, 20 bp, Artificial Sequence
  sgRNA
  NTC_2699
cgatcgatgagcgacgcgtt

SEQ ID NO: 67447 - DNA, 20 bp, Artificial Sequence
  sgRNA
  NTC_2700
tcgtctaggcgacgaccgag

SEQ ID NO: 67448 - DNA, 20 bp, Artificial Sequence
  sgRNA
  NTC_2701
ttaaggtacgagtgcaccga

SEQ ID NO: 67449 - DNA, 20 bp, Artificial Sequence
  sgRNA
  NTC_2702
tcttatgcagtcgcgaaatt

SEQ ID NO: 67450 - DNA, 20 bp, Artificial Sequence
  sgRNA
  NTC_2703
aagtcggttatcgcacgcgt

SEQ ID NO: 67451 - DNA, 20 bp, Artificial Sequence
  sgRNA
  NTC_2704
ggctctttgtataccgcctc

SEQ ID NO: 67452 - DNA, 20 bp, Artificial Sequence
  sgRNA
  NTC_2705
cgttcagttgcttacgagcg

SEQ ID NO: 67453 - DNA, 20 bp, Artificial Sequence
  sgRNA
  NTC_2706
gagacaaattacgcgtttac

SEQ ID NO: 67454 - DNA, 20 bp, Artificial Sequence
  sgRNA
  NTC_2707
gcgagactagagtcgtcgtc

SEQ ID NO: 67455 - DNA, 20 bp, Artificial Sequence
  sgRNA
  NTC_2708
tattactgatgccgttcgag

SEQ ID NO: 67456 - DNA, 20 bp, Artificial Sequence
  sgRNA
  NTC_2709
tgggcttcgtcagacgacga

SEQ ID NO: 67457 - DNA, 20 bp, Artificial Sequence
  sgRNA
  NTC_2710
cgaactatatgcaccgccac

SEQ ID NO: 67458 - DNA, 20 bp, Artificial Sequence
  sgRNA
  NTC_2711
ttagaagcacacgtcgcgag

SEQ ID NO: 67459 - DNA, 20 bp, Artificial Sequence
  sgRNA
  NTC_2712
cgcataggcgctttacgaac

SEQ ID NO: 67460 - DNA, 20 bp, Artificial Sequence
  sgRNA
  NTC_2713
tcaacgcgctgtcgcatgtt

SEQ ID NO: 67461 - DNA, 20 bp, Artificial Sequence
  sgRNA
  NTC_2714
gtggttggctcgcgttgctg

SEQ ID NO: 67462 - DNA, 20 bp, Artificial Sequence
  sgRNA
  NTC_2715
gtcaaaatgggttgcgcgac

SEQ ID NO: 67463 - DNA, 20 bp, Artificial Sequence
  sgRNA
  NTC_2716
ttcgtcgataacaaactgcg

SEQ ID NO: 67464 - DNA, 20 bp, Artificial Sequence
  sgRNA
  NTC_2717
aacaaaaaggggcgcgctac

SEQ ID NO: 67465 - DNA, 20 bp, Artificial Sequence
  sgRNA
  NTC_2718
tcggatacactcaccgatct

SEQ ID NO: 67466 - DNA, 20 bp, Artificial Sequence
  sgRNA
  NTC_2719
taggcgatcacgtcactcta

SEQ ID NO: 67467 - DNA, 20 bp, Artificial Sequence
  sgRNA
  NTC_2720
tatcgatagttccgcgttac

SEQ ID NO: 67468 - DNA, 20 bp, Artificial Sequence
  sgRNA
  NTC_2721
gtagatatcacgtgcgacta

SEQ ID NO: 67469 - DNA, 20 bp, Artificial Sequence
  sgRNA
  NTC_2722
tgtggttcgttgtacgctat

SEQ ID NO: 67470 - DNA, 20 bp, Artificial Sequence
  sgRNA
  NTC_2723
gctagtagctcgaatccgcc

SEQ ID NO: 67471 - DNA, 20 bp, Artificial Sequence
  sgRNA
  NTC_2724
gctcgcaagttgaacgtact

SEQ ID NO: 67472 - DNA, 20 bp, Artificial Sequence
  sgRNA
  NTC_2725
cggtctactatgtacgcatt

SEQ ID NO: 67473 - DNA, 20 bp, Artificial Sequence
  sgRNA
  NTC_2726
gctttgtcaggacccgttat

SEQ ID NO: 67474 - DNA, 20 bp, Artificial Sequence
  sgRNA
  NTC_2727
ggtcggcgcgaatatattat

SEQ ID NO: 67475 - DNA, 20 bp, Artificial Sequence
  sgRNA
  NTC_2728
ttactctcgggttgcgacta

SEQ ID NO: 67476 - DNA, 20 bp, Artificial Sequence
  sgRNA
  NTC_2729
gtttgatctattcgcgagtt

SEQ ID NO: 67477 - DNA, 20 bp, Artificial Sequence
  sgRNA
  NTC_2730
acgcgaaatcgctccgaaac

SEQ ID NO: 67478 - DNA, 20 bp, Artificial Sequence
  sgRNA
  NTC_2731
gtacgacgggtgcgctccga

SEQ ID NO: 67479 - DNA, 20 bp, Artificial Sequence
  sgRNA
  NTC_2732
tcgatacgaagcgaacacgc

SEQ ID NO: 67480 - DNA, 20 bp, Artificial Sequence
  sgRNA
  NTC_2733
cgcatcggaatacacgtctg

SEQ ID NO: 67481 - DNA, 20 bp, Artificial Sequence
  sgRNA
  NTC_2734
ttagtcaactgcaacgacga

SEQ ID NO: 67482 - DNA, 20 bp, Artificial Sequence
  sgRNA
  NTC_2735
ttcggcgcgcaagactctat

SEQ ID NO: 67483 - DNA, 20 bp, Artificial Sequence
  sgRNA
  NTC_2736
agggtacatcgccgcgatag

SEQ ID NO: 67484 - DNA, 20 bp, Artificial Sequence
  sgRNA
  NTC_2737
atagtcgtagacacccccgc

SEQ ID NO: 67485 - DNA, 20 bp, Artificial Sequence
  sgRNA
  NTC_2738
ctcgtcagattaccgcgtta

SEQ ID NO: 67486 - DNA, 20 bp, Artificial Sequence
  sgRNA
  NTC_2739
agtgcgttgcacaacgtcac

SEQ ID NO: 67487 - DNA, 20 bp, Artificial Sequence
  sgRNA
  NTC_2740
aaattgtacgcgatagaacg

SEQ ID NO: 67488 - DNA, 20 bp, Artificial Sequence
  sgRNA
  NTC_2741
cgtgcggtaagcgaacgctc

SEQ ID NO: 67489 - DNA, 20 bp, Artificial Sequence
  sgRNA
  NTC_2742
gtgattaacgacagtccgat

SEQ ID NO: 67490 - DNA, 20 bp, Artificial Sequence
  sgRNA
  NTC_2743
gggtcggcacacgcgttgtg

SEQ ID NO: 67491 - DNA, 20 bp, Artificial Sequence
  sgRNA
  NTC_2744
tcggcgcggtgcccaatgat

SEQ ID NO: 67492 - DNA, 20 bp, Artificial Sequence
  sgRNA
  NTC_2745
actaaaagcgggcccgattt

SEQ ID NO: 67493 - DNA, 20 bp, Artificial Sequence
  sgRNA
  NTC_2746
tcgtcgaggtagatcgtata

SEQ ID NO: 67494 - DNA, 20 bp, Artificial Sequence
  sgRNA
  NTC_2747
atgacgttgaggctcgctac

SEQ ID NO: 67495 - DNA, 20 bp, Artificial Sequence
  sgRNA
  NTC_2748
tcgtcacttgtaacgtcgta

SEQ ID NO: 67496 - DNA, 20 bp, Artificial Sequence
  sgRNA
  NTC_2749
tgcatggcgcaatacatcgc

SEQ ID NO: 67497 - DNA, 20 bp, Artificial Sequence
  sgRNA
  NTC_2750
cggcgacggactcgcgttag

SEQ ID NO: 67498 - DNA, 20 bp, Artificial Sequence
  sgRNA
  NTC_2751
acgcgcgtctggcgtgccgt

SEQ ID NO: 67499 - DNA, 20 bp, Artificial Sequence
  sgRNA
  NTC_2752
aagtcgacggtccgttatat

SEQ ID NO: 67500 - DNA, 20 bp, Artificial Sequence
  sgRNA
  NTC_2753
ggacgcatattgcgactccc

SEQ ID NO: 67501 - DNA, 20 bp, Artificial Sequence
  sgRNA
  NTC_2754
gtgcacgcgacagaagcgat

SEQ ID NO: 67502 - DNA, 20 bp, Artificial Sequence
  sgRNA
  NTC_2755
gctgtagtaataccgcatac

SEQ ID NO: 67503 - DNA, 20 bp, Artificial Sequence
  sgRNA
  NTC_2756
gcgattggctgtaaccgacg

SEQ ID NO: 67504 - DNA, 20 bp, Artificial Sequence
  sgRNA
  NTC_2757
gtaacaatggtagcgacgac

SEQ ID NO: 67505 - DNA, 20 bp, Artificial Sequence
  sgRNA
  NTC_2758
acgacgagcggtacgacctt

SEQ ID NO: 67506 - DNA, 20 bp, Artificial Sequence
  sgRNA
  NTC_2759
tcgaaaactgacgttagcgt

SEQ ID NO: 67507 - DNA, 20 bp, Artificial Sequence
  sgRNA
  NTC_2760
ctcgtcaatattacgacaat

SEQ ID NO: 67508 - DNA, 20 bp, Artificial Sequence
  sgRNA
  NTC_2761
gcggcgaacagaccttacat

SEQ ID NO: 67509 - DNA, 20 bp, Artificial Sequence
  sgRNA
  NTC_2762
gcttgacaggtaatcgagaa

SEQ ID NO: 67510 - DNA, 20 bp, Artificial Sequence
  sgRNA
  NTC_2763
acaggacgattcgacttcga

SEQ ID NO: 67511 - DNA, 20 bp, Artificial Sequence
  sgRNA
  NTC_2764
agcggagcgtacgagctcgt

SEQ ID NO: 67512 - DNA, 20 bp, Artificial Sequence
  sgRNA
  NTC_2765
agctagtttctcgacgcgcg

SEQ ID NO: 67513 - DNA, 20 bp, Artificial Sequence
  sgRNA
  NTC_2766
attcgcgtatactgttcgtc

SEQ ID NO: 67514 - DNA, 20 bp, Artificial Sequence
  sgRNA
  NTC_2767
aatggggcaacgcacacgat

SEQ ID NO: 67515 - DNA, 20 bp, Artificial Sequence
  sgRNA
  NTC_2768
acgttcaacgttccgcgaca

SEQ ID NO: 67516 - DNA, 20 bp, Artificial Sequence
  sgRNA
  NTC_2769
cgacagcgcgactcgatcaa

SEQ ID NO: 67517 - DNA, 20 bp, Artificial Sequence
  sgRNA
  NTC_2770
atactattcgggatccgacc

SEQ ID NO: 67518 - DNA, 20 bp, Artificial Sequence
  sgRNA
  NTC_2771
agaacagcgtgtccgtcgtt

SEQ ID NO: 67519 - DNA, 20 bp, Artificial Sequence
  sgRNA
  NTC_2772
cggtcacgacgtttcgaaga

SEQ ID NO: 67520 - DNA, 20 bp, Artificial Sequence
  sgRNA
  NTC_2773
ctcgatcggggccgattacg

SEQ ID NO: 67521 - DNA, 20 bp, Artificial Sequence
  sgRNA
  NTC_2774
ttcataacggtacgctctaa

SEQ ID NO: 67522 - DNA, 20 bp, Artificial Sequence
  sgRNA
  NTC_2775
tcgcatcactgtgacgcgta

SEQ ID NO: 67523 - DNA, 20 bp, Artificial Sequence
  sgRNA
  NTC_2776
ctcgctatcgtcgctaacag

SEQ ID NO: 67524 - DNA, 20 bp, Artificial Sequence
  sgRNA
  NTC_2777
ttcaggtgcgcatccgagtt

SEQ ID NO: 67525 - DNA, 20 bp, Artificial Sequence
  sgRNA
  NTC_2778
tgtgtaatgcgacccgagtg

SEQ ID NO: 67526 - DNA, 20 bp, Artificial Sequence
  sgRNA
  NTC_2779
taagtcacgtgccgcagttc

SEQ ID NO: 67527 - DNA, 20 bp, Artificial Sequence
  sgRNA
  NTC_2780
tcaaactttggcgccgtatt

SEQ ID NO: 67528 - DNA, 20 bp, Artificial Sequence
  sgRNA
  NTC_2781
gtcgcgtctcgctgactata

SEQ ID NO: 67529 - DNA, 20 bp, Artificial Sequence
  sgRNA
  NTC_2782
gtcgctattacatcgtccga

SEQ ID NO: 67530 - DNA, 20 bp, Artificial Sequence
  sgRNA
  NTC_2783
acgcagacggttcccgctac

SEQ ID NO: 67531 - DNA, 20 bp, Artificial Sequence
  sgRNA
  NTC_2784
ggatcgtaggcgcttacgat

SEQ ID NO: 67532 - DNA, 20 bp, Artificial Sequence
  sgRNA
  NTC_2785
ttcagcgacaagcgctatga

SEQ ID NO: 67533 - DNA, 20 bp, Artificial Sequence
  sgRNA
  NTC_2786
tgtgttggtcgcgaaaaatc

SEQ ID NO: 67534 - DNA, 20 bp, Artificial Sequence
  sgRNA
  NTC_2787
atacatctcagttccgcgta

SEQ ID NO: 67535 - DNA, 20 bp, Artificial Sequence
  sgRNA
  NTC_2788
gcgtcgcgctattcacgact

SEQ ID NO: 67536 - DNA, 20 bp, Artificial Sequence
  sgRNA
  NTC_2789
gtactcgtcacgacgcaaat

SEQ ID NO: 67537 - DNA, 20 bp, Artificial Sequence
  sgRNA
  NTC_2790
tcttgggacgttactcgtcc

SEQ ID NO: 67538 - DNA, 20 bp, Artificial Sequence
  sgRNA
  NTC_2791
aactagaaattacgcacgtg

SEQ ID NO: 67539 - DNA, 20 bp, Artificial Sequence
  sgRNA
  NTC_2792
gtatcgatctcatccgacca

SEQ ID NO: 67540 - DNA, 20 bp, Artificial Sequence
  sgRNA
  NTC_2793
tgagttcggcatcgatacga

SEQ ID NO: 67541 - DNA, 20 bp, Artificial Sequence
  sgRNA
  NTC_2794
gctatggaacgcgaatcgag

SEQ ID NO: 67542 - DNA, 20 bp, Artificial Sequence
  sgRNA
  NTC_2795
tcaatcacggcgtatcccga

SEQ ID NO: 67543 - DNA, 20 bp, Artificial Sequence
  sgRNA
  NTC_2796
atacgaatttgtgtcgacgc

SEQ ID NO: 67544 - DNA, 20 bp, Artificial Sequence
  sgRNA
  NTC_2797
atctttatggacgcgacgtc

SEQ ID NO: 67545 - DNA, 20 bp, Artificial Sequence
  sgRNA
  NTC_2798
gacgagcgtggtttcgcgat

SEQ ID NO: 67546 - DNA, 20 bp, Artificial Sequence
  sgRNA
  NTC_2799
acgtataataatcgtacgcc

SEQ ID NO: 67547 - DNA, 20 bp, Artificial Sequence
  sgRNA
  NTC_2800
gtcaagtgtggccgcgtata

SEQ ID NO: 67548 - DNA, 20 bp, Artificial Sequence
  sgRNA
  NTC_2801
gactacgctacgcgtagcat

SEQ ID NO: 67549 - DNA, 20 bp, Artificial Sequence
  sgRNA
  NTC_2802
cagcgcactagaagtcgtgt

SEQ ID NO: 67550 - DNA, 20 bp, Artificial Sequence
  sgRNA
  NTC_2803
gactttcgatgacgccgtaa

SEQ ID NO: 67551 - DNA, 20 bp, Artificial Sequence
  sgRNA
  NTC_2804
gcgttcgtacgctccgccag

SEQ ID NO: 67552 - DNA, 20 bp, Artificial Sequence
  sgRNA
  NTC_2805
gcggtcaatagcatcgtacc

SEQ ID NO: 67553 - DNA, 20 bp, Artificial Sequence
  sgRNA
  NTC_2806
gattgggtgaggtgcgactc

SEQ ID NO: 67554 - DNA, 20 bp, Artificial Sequence
  sgRNA
  NTC_2807
agcgtggtacggtccgaata

SEQ ID NO: 67555 - DNA, 20 bp, Artificial Sequence
  sgRNA
  NTC_2808
gtgcacttaacgcgtcgtct

SEQ ID NO: 67556 - DNA, 20 bp, Artificial Sequence
  sgRNA
  NTC_2809
agcgatcgcgcgtctatcaa

SEQ ID NO: 67557 - DNA, 20 bp, Artificial Sequence
  sgRNA
  NTC_2810
tagtcgcgcaaccgatgtta

SEQ ID NO: 67558 - DNA, 20 bp, Artificial Sequence
  sgRNA
  NTC_2811
tcggcacgttacgccgacaa

SEQ ID NO: 67559 - DNA, 20 bp, Artificial Sequence
  sgRNA
  NTC_2812
ggaaatttacgatgcgacca

SEQ ID NO: 67560 - DNA, 20 bp, Artificial Sequence
  sgRNA
  NTC_2813
gttcgcgacgtcacgccgct

SEQ ID NO: 67561 - DNA, 20 bp, Artificial Sequence
  sgRNA
  NTC_2814
ggtatctaatcgtcgacgcg

SEQ ID NO: 67562 - DNA, 20 bp, Artificial Sequence
  sgRNA
  NTC_2815
gatcgcatcgctcgagacga

SEQ ID NO: 67563 - DNA, 20 bp, Artificial Sequence
  sgRNA
  NTC_2816
tcttatactacgtccgtcgc

SEQ ID NO: 67564 - DNA, 20 bp, Artificial Sequence
  sgRNA
  NTC_2817
gtttatgatatgccttcgcg

SEQ ID NO: 67565 - DNA, 20 bp, Artificial Sequence
  sgRNA
  NTC_2818
ttacggcgctaatagttcgc

SEQ ID NO: 67566 - DNA, 20 bp, Artificial Sequence
  sgRNA
  NTC_2819
gcatagtcgtgcaagcgcgc

SEQ ID NO: 67567 - DNA, 20 bp, Artificial Sequence
  sgRNA
  NTC_2820
tttgggatgttccgctcgat

SEQ ID NO: 67568 - DNA, 20 bp, Artificial Sequence
  sgRNA
  NTC_2821
atcggcattattcccgcgaa

SEQ ID NO: 67569 - DNA, 20 bp, Artificial Sequence
  sgRNA
  NTC_2822
cttggcgattgcacgtaatc

SEQ ID NO: 67570 - DNA, 20 bp, Artificial Sequence
  sgRNA
  NTC_2823
gttcggtcaggtcgcgcgaa

SEQ ID NO: 67571 - DNA, 20 bp, Artificial Sequence
  sgRNA
  NTC_2824
tcgtcggctattgcgtcgca

SEQ ID NO: 67572 - DNA, 20 bp, Artificial Sequence
  sgRNA
  NTC_2825
ctacacgtcgcgcacagttc

SEQ ID NO: 67573 - DNA, 20 bp, Artificial Sequence
  sgRNA
  NTC_2826
tacagtgttgcgcgtaaagt

SEQ ID NO: 67574 - DNA, 20 bp, Artificial Sequence
  sgRNA
  NTC_2827
aggttctcgtatgccgtaat

SEQ ID NO: 67575 - DNA, 20 bp, Artificial Sequence
  sgRNA
  NTC_2828
ggagctagatctaccgacat

SEQ ID NO: 67576 - DNA, 20 bp, Artificial Sequence
  sgRNA
  NTC_2829
tggttcggcggccgtcgtac

SEQ ID NO: 67577 - DNA, 20 bp, Artificial Sequence
  sgRNA
  NTC_2830
gtacttacacgcacgagatc

SEQ ID NO: 67578 - DNA, 20 bp, Artificial Sequence
  sgRNA
  NTC_2831
acgcacttcgtagaccgtcg

SEQ ID NO: 67579 - DNA, 20 bp, Artificial Sequence
  sgRNA
  NTC_2832
gcgttgcaacggttgacgcg

SEQ ID NO: 67580 - DNA, 20 bp, Artificial Sequence
  sgRNA
  NTC_2833
gaggcgcggatgcgttcgac

SEQ ID NO: 67581 - DNA, 20 bp, Artificial Sequence
  sgRNA
  NTC_2834
tgacgtatttctaacgatcg

SEQ ID NO: 67582 - DNA, 20 bp, Artificial Sequence
  sgRNA
  NTC_2835
gttaagtcgacttcgctcgt

SEQ ID NO: 67583 - DNA, 20 bp, Artificial Sequence
  sgRNA
  NTC_2836
gcgttggatcagtacgtatt

SEQ ID NO: 67584 - DNA, 20 bp, Artificial Sequence
  sgRNA
  NTC_2837
cgtgaactcgtacgcgatgt

SEQ ID NO: 67585 - DNA, 20 bp, Artificial Sequence
  sgRNA
  NTC_2838
tgtcattcacgatgcatata

SEQ ID NO: 67586 - DNA, 20 bp, Artificial Sequence
  sgRNA
  NTC_2839
aagcggagcgttacgcgctt

SEQ ID NO: 67587 - DNA, 20 bp, Artificial Sequence
  sgRNA
  NTC_2840
ggtcgcgatacgtcgttctt

SEQ ID NO: 67588 - DNA, 20 bp, Artificial Sequence
  sgRNA
  NTC_2841
tttctcgcgtgtacccaatc

SEQ ID NO: 67589 - DNA, 20 bp, Artificial Sequence
  sgRNA
  NTC_2842
acggtcggttgaaacgcacc

SEQ ID NO: 67590 - DNA, 20 bp, Artificial Sequence
  sgRNA
  NTC_2843
gcgagtatgctttacgtcgc

SEQ ID NO: 67591 - DNA, 20 bp, Artificial Sequence
  sgRNA
  NTC_2844
acacgctgacgtcgcgagaa

SEQ ID NO: 67592 - DNA, 20 bp, Artificial Sequence
  sgRNA
  NTC_2845
gtaacacgcagcccgcgacc

SEQ ID NO: 67593 - DNA, 20 bp, Artificial Sequence
  sgRNA
  NTC_2846
acggtttgcgcgctccacga

SEQ ID NO: 67594 - DNA, 20 bp, Artificial Sequence
  sgRNA
  NTC_2847
tcgcggaaggaacgtccatt

SEQ ID NO: 67595 - DNA, 20 bp, Artificial Sequence
  sgRNA
  NTC_2848
gcgatgcggataactacctc

SEQ ID NO: 67596 - DNA, 20 bp, Artificial Sequence
  sgRNA
  NTC_2849
cggctaaatggtgacgatag

SEQ ID NO: 67597 - DNA, 20 bp, Artificial Sequence
  sgRNA
  NTC_2850
ggaatcaggtacagcgacgt

SEQ ID NO: 67598 - DNA, 20 bp, Artificial Sequence
  sgRNA
  NTC_2851
ctacgaacgcgcacgataaa

SEQ ID NO: 67599 - DNA, 20 bp, Artificial Sequence
  sgRNA
  NTC_2852
agtagcactcgcgcgcgaca

SEQ ID NO: 67600 - DNA, 20 bp, Artificial Sequence
  sgRNA
  NTC_2853
gtgactacggatcgtcacgc

SEQ ID NO: 67601 - DNA, 20 bp, Artificial Sequence
  sgRNA
  NTC_2854
tatgcgtattcgaagagcgt

SEQ ID NO: 67602 - DNA, 20 bp, Artificial Sequence
  sgRNA
  NTC_2855
tcggcaacggagacttacgc

SEQ ID NO: 67603 - DNA, 20 bp, Artificial Sequence
  sgRNA
  NTC_2856
agtgcatagaactacgagcg

SEQ ID NO: 67604 - DNA, 20 bp, Artificial Sequence
  sgRNA
  NTC_2857
acagctcgtcgacgaactac

SEQ ID NO: 67605 - DNA, 20 bp, Artificial Sequence
  sgRNA
  NTC_2858
tcgatatcgactttcgccta

SEQ ID NO: 67606 - DNA, 20 bp, Artificial Sequence
  sgRNA
  NTC_2859
agtcgttcggtaccgcctca

SEQ ID NO: 67607 - DNA, 20 bp, Artificial Sequence
  sgRNA
  NTC_2860
cgcgcgcaattgattcatga

SEQ ID NO: 67608 - DNA, 20 bp, Artificial Sequence
  sgRNA
  NTC_2861
cgtttgggtctcacccgtcg

SEQ ID NO: 67609 - DNA, 20 bp, Artificial Sequence
  sgRNA
  NTC_2862
acgcacagtggttccgctac

SEQ ID NO: 67610 - DNA, 20 bp, Artificial Sequence
  sgRNA
  NTC_2863
tgcgatgcatgcgccgacgc

SEQ ID NO: 67611 - DNA, 20 bp, Artificial Sequence
  sgRNA
  NTC_2864
cgtcagcgtacaactaatcg

SEQ ID NO: 67612 - DNA, 20 bp, Artificial Sequence
  sgRNA
  NTC_2865
gcgaaaatgtgagacgtgtc

SEQ ID NO: 67613 - DNA, 20 bp, Artificial Sequence
  sgRNA
  NTC_2866
ggcgtctgtttcgcctctcg

SEQ ID NO: 67614 - DNA, 20 bp, Artificial Sequence
  sgRNA
  NTC_2867
gggtattagaaatcgctaac

SEQ ID NO: 67615 - DNA, 20 bp, Artificial Sequence
  sgRNA
  NTC_2868
gagtcgatttgagcgccgag

SEQ ID NO: 67616 - DNA, 20 bp, Artificial Sequence
  sgRNA
  NTC_2869
gttctgtacgcgccgcgcat

SEQ ID NO: 67617 - DNA, 20 bp, Artificial Sequence
  sgRNA
  NTC_2870
gacgcgtgagattacgtttc

SEQ ID NO: 67618 - DNA, 20 bp, Artificial Sequence
  sgRNA
  NTC_2871
attaacgttcgctacgttac

SEQ ID NO: 67619 - DNA, 20 bp, Artificial Sequence
  sgRNA
  NTC_2872
actttacggcacgccgtatg

SEQ ID NO: 67620 - DNA, 20 bp, Artificial Sequence
  sgRNA
  NTC_2873
cttcggttctatcgcgcaca

SEQ ID NO: 67621 - DNA, 20 bp, Artificial Sequence
  sgRNA
  NTC_2874
tgtcggacgtatcttcgtcg

SEQ ID NO: 67622 - DNA, 20 bp, Artificial Sequence
  sgRNA
  NTC_2875
gggaggacgcaccacgtcag

SEQ ID NO: 67623 - DNA, 20 bp, Artificial Sequence
  sgRNA
  NTC_2876
gatagaacgctcgcgactcc

SEQ ID NO: 67624 - DNA, 20 bp, Artificial Sequence
  sgRNA
  NTC_2877
taggggctatcgatgcgtat

SEQ ID NO: 67625 - DNA, 20 bp, Artificial Sequence
  sgRNA
  NTC_2878
taaaattcacgccttcgcgc

SEQ ID NO: 67626 - DNA, 20 bp, Artificial Sequence
  sgRNA
  NTC_2879
gcttcttatgaccccgttat

SEQ ID NO: 67627 - DNA, 20 bp, Artificial Sequence
  sgRNA
  NTC_2880
tcgaaggtgtacctcgtttc

SEQ ID NO: 67628 - DNA, 20 bp, Artificial Sequence
  sgRNA
  NTC_2881
acatcgtcatgctgcgatta

SEQ ID NO: 67629 - DNA, 20 bp, Artificial Sequence
  sgRNA
  NTC_2882
gtgcagaatagtccccgacg

SEQ ID NO: 67630 - DNA, 20 bp, Artificial Sequence
  sgRNA
  NTC_2883
atgtatcgggttgccccgtc

SEQ ID NO: 67631 - DNA, 20 bp, Artificial Sequence
  sgRNA
  NTC_2884
tctaaacgcacgcaccgtcg

SEQ ID NO: 67632 - DNA, 20 bp, Artificial Sequence
  sgRNA
  NTC_2885
ctcgcacgaagccccgctat

SEQ ID NO: 67633 - DNA, 20 bp, Artificial Sequence
  sgRNA
  NTC_2886
actgggcaggacgccataac

SEQ ID NO: 67634 - DNA, 20 bp, Artificial Sequence
  sgRNA
  NTC_2887
ttgtgattacgtgtcgcccg

SEQ ID NO: 67635 - DNA, 20 bp, Artificial Sequence
  sgRNA
  NTC_2888
acagcgaaacggtgtaccgt

SEQ ID NO: 67636 - DNA, 20 bp, Artificial Sequence
  sgRNA
  NTC_2889
agtcgcgatttcacgtagat

SEQ ID NO: 67637 - DNA, 20 bp, Artificial Sequence
  sgRNA
  NTC_2890
acggcgtattcgacacccga

SEQ ID NO: 67638 - DNA, 20 bp, Artificial Sequence
  sgRNA
  NTC_2891
ggtcgttcggacgtctacga

SEQ ID NO: 67639 - DNA, 20 bp, Artificial Sequence
  sgRNA
  NTC_2892
ctcgaggctacgtcgacgcc

SEQ ID NO: 67640 - DNA, 20 bp, Artificial Sequence
  sgRNA
  NTC_2893
cggtagaagaaacccccgcg

SEQ ID NO: 67641 - DNA, 20 bp, Artificial Sequence
  sgRNA
  NTC_2894
cacgactgcagcttgcgtcg

SEQ ID NO: 67642 - DNA, 20 bp, Artificial Sequence
  sgRNA
  NTC_2895
aacgtcgggaaaccgcctct

SEQ ID NO: 67643 - DNA, 20 bp, Artificial Sequence
  sgRNA
  NTC_2896
acgcgaacggttgcccactc

SEQ ID NO: 67644 - DNA, 20 bp, Artificial Sequence
  sgRNA
  NTC_2897
atcgaacgaagagtcgaatc

SEQ ID NO: 67645 - DNA, 20 bp, Artificial Sequence
  sgRNA
  NTC_2898
cgtagcaatcatccgcgcaa

SEQ ID NO: 67646 - DNA, 20 bp, Artificial Sequence
  sgRNA
  NTC_2899
gtgctatgcggcgtcaatcg

SEQ ID NO: 67647 - DNA, 20 bp, Artificial Sequence
  sgRNA
  NTC_2900
gttcagtggtcaattcgacg

SEQ ID NO: 67648 - DNA, 20 bp, Artificial Sequence
  sgRNA
  NTC_2901
cagatcgcaatacaccgatc

SEQ ID NO: 67649 - DNA, 20 bp, Artificial Sequence
  sgRNA
  NTC_2902
aatagctgcggtagcgttcg

SEQ ID NO: 67650 - DNA, 20 bp, Artificial Sequence
  sgRNA
  NTC_2903
cggttgggtagcgctccgtt

SEQ ID NO: 67651 - DNA, 20 bp, Artificial Sequence
  sgRNA
  NTC_2904
gagcgacagcgcaacgtcgt

SEQ ID NO: 67652 - DNA, 20 bp, Artificial Sequence
  sgRNA
  NTC_2905
gggtgctagtcaaccgaaac

SEQ ID NO: 67653 - DNA, 20 bp, Artificial Sequence
  sgRNA
  NTC_2906
tctcgatgtatacgtccgcg

SEQ ID NO: 67654 - DNA, 20 bp, Artificial Sequence
  sgRNA
  NTC_2907
acgtcgaggcgtcgcgtcgc

SEQ ID NO: 67655 - DNA, 20 bp, Artificial Sequence
  sgRNA
  NTC_2908
gcgtgggcttcgatcgacga

SEQ ID NO: 67656 - DNA, 20 bp, Artificial Sequence
  sgRNA
  NTC_2909
gggctcgagtactcgaaatt

SEQ ID NO: 67657 - DNA, 20 bp, Artificial Sequence
  sgRNA
  NTC_2910
atcggggtagtacgagtcat

SEQ ID NO: 67658 - DNA, 20 bp, Artificial Sequence
  sgRNA
  NTC_2911
tgtacgatcttcaacgtaag

SEQ ID NO: 67659 - DNA, 20 bp, Artificial Sequence
  sgRNA
  NTC_2912
ggcgcgcagtttgcgctaag

SEQ ID NO: 67660 - DNA, 20 bp, Artificial Sequence
  sgRNA
  NTC_2913
tcgcaatgctaagacccgtc

SEQ ID NO: 67661 - DNA, 20 bp, Artificial Sequence
  sgRNA
  NTC_2914
gacgtgggatatacgcttat

SEQ ID NO: 67662 - DNA, 20 bp, Artificial Sequence
  sgRNA
  NTC_2915
ggcgggaaaatcgcgctacc

SEQ ID NO: 67663 - DNA, 20 bp, Artificial Sequence
  sgRNA
  NTC_2916
aagcgcggcataaacgattc

SEQ ID NO: 67664 - DNA, 20 bp, Artificial Sequence
  sgRNA
  NTC_2917
gactttcgctgactgcgcgt

SEQ ID NO: 67665 - DNA, 20 bp, Artificial Sequence
  sgRNA
  NTC_2918
tcgaatcggtctcgacgtga

SEQ ID NO: 67666 - DNA, 20 bp, Artificial Sequence
  sgRNA
  NTC_2919
gattgaggcgacgttaacga

SEQ ID NO: 67667 - DNA, 20 bp, Artificial Sequence
  sgRNA
  NTC_2920
gctgcgtacgtgactcgaaa

SEQ ID NO: 67668 - DNA, 20 bp, Artificial Sequence
  sgRNA
  NTC_2921
ctggctagtacgtttcgtca

SEQ ID NO: 67669 - DNA, 20 bp, Artificial Sequence
  sgRNA
  NTC_2922
gagcgacatacgtcgatgta

SEQ ID NO: 67670 - DNA, 20 bp, Artificial Sequence
  sgRNA
  NTC_2923
tattgcggcactgccgcgcc

SEQ ID NO: 67671 - DNA, 20 bp, Artificial Sequence
  sgRNA
  NTC_2924
ttggcgtgttagagcgctct

SEQ ID NO: 67672 - DNA, 20 bp, Artificial Sequence
  sgRNA
  NTC_2925
cggcattgcggccgtcgcac

SEQ ID NO: 67673 - DNA, 20 bp, Artificial Sequence
  sgRNA
  NTC_2926
tgatacgtcggtacgatgag

SEQ ID NO: 67674 - DNA, 20 bp, Artificial Sequence
  sgRNA
  NTC_2927
ttagcgcaacgtgttcgcga

SEQ ID NO: 67675 - DNA, 20 bp, Artificial Sequence
  sgRNA
  NTC_2928
cgtatggcgttacgaaaacg

SEQ ID NO: 67676 - DNA, 20 bp, Artificial Sequence
  sgRNA
  NTC_2929
cggacgcgctacaaccgaag

SEQ ID NO: 67677 - DNA, 20 bp, Artificial Sequence
  sgRNA
  NTC_2930
gcggggaataacgcccgagt

SEQ ID NO: 67678 - DNA, 20 bp, Artificial Sequence
  sgRNA
  NTC_2931
cgacggcaattcgtcgccgt

SEQ ID NO: 67679 - DNA, 20 bp, Artificial Sequence
  sgRNA
  NTC_2932
cgatggatatcgccgactat

SEQ ID NO: 67680 - DNA, 20 bp, Artificial Sequence
  sgRNA
  NTC_2933
ggtgcgcgaggatacatccg

SEQ ID NO: 67681 - DNA, 20 bp, Artificial Sequence
  sgRNA
  NTC_2934
ttacggtacgtctacacgaa

SEQ ID NO: 67682 - DNA, 20 bp, Artificial Sequence
  sgRNA
  NTC_2935
gtaactactagacgcagcgt

SEQ ID NO: 67683 - DNA, 20 bp, Artificial Sequence
  sgRNA
  NTC_2936
tgcgacgagaaccgactgtt

SEQ ID NO: 67684 - DNA, 20 bp, Artificial Sequence
  sgRNA
  NTC_2937
acgggtgtataccgcgccgt

SEQ ID NO: 67685 - DNA, 20 bp, Artificial Sequence
  sgRNA
  NTC_2938
taacatcgcgtcgactatac

SEQ ID NO: 67686 - DNA, 20 bp, Artificial Sequence
  sgRNA
  NTC_2939
tcgactaggcaaattactag

SEQ ID NO: 67687 - DNA, 20 bp, Artificial Sequence
  sgRNA
  NTC_2940
ttacgtacagtccgcttatc

SEQ ID NO: 67688 - DNA, 20 bp, Artificial Sequence
  sgRNA
  NTC_2941
gcgcgttaagaaattcgctt

SEQ ID NO: 67689 - DNA, 20 bp, Artificial Sequence
  sgRNA
  NTC_2942
gtgtgttatgcgcgcaatca

SEQ ID NO: 67690 - DNA, 20 bp, Artificial Sequence
  sgRNA
  NTC_2943
ctcgggtcggcacatttacg

SEQ ID NO: 67691 - DNA, 20 bp, Artificial Sequence
  sgRNA
  NTC_2944
tgatcacggatcgtgacacg

SEQ ID NO: 67692 - DNA, 20 bp, Artificial Sequence
  sgRNA
  NTC_2945
cgagtcgtcacacgcgcaat

SEQ ID NO: 67693 - DNA, 20 bp, Artificial Sequence
  sgRNA
  NTC_2946
gggcattctgacaacgaccg

SEQ ID NO: 67694 - DNA, 20 bp, Artificial Sequence
  sgRNA
  NTC_2947
aagaacacgtcgcttaatcg

SEQ ID NO: 67695 - DNA, 20 bp, Artificial Sequence
  sgRNA
  NTC_2948
ttcgcggtatgaatcgtgaa

SEQ ID NO: 67696 - DNA, 20 bp, Artificial Sequence
  sgRNA
  NTC_2949
tgcgcgtctatcgtgccgct

SEQ ID NO: 67697 - DNA, 20 bp, Artificial Sequence
  sgRNA
  NTC_2950
aagcggatgagttgcgtcta

SEQ ID NO: 67698 - DNA, 20 bp, Artificial Sequence
  sgRNA
  NTC_2951
tgcggaaaaagccctacgca

SEQ ID NO: 67699 - DNA, 20 bp, Artificial Sequence
  sgRNA
  NTC_2952
tattgcacggtcacgcgagt

SEQ ID NO: 67700 - DNA, 20 bp, Artificial Sequence
  sgRNA
  NTC_2953
tggaggggacgaccgtccgt

SEQ ID NO: 67701 - DNA, 20 bp, Artificial Sequence
  sgRNA
  NTC_2954
gtagcggttacgatacgcgt

SEQ ID NO: 67702 - DNA, 20 bp, Artificial Sequence
  sgRNA
  NTC_2955
gagtgtcgctcgcctatacg

SEQ ID NO: 67703 - DNA, 20 bp, Artificial Sequence
  sgRNA
  NTC_2956
ggttggactacgcgtataga

SEQ ID NO: 67704 - DNA, 20 bp, Artificial Sequence
  sgRNA
  NTC_2957
cggtcgtaactcttcacgtt

SEQ ID NO: 67705 - DNA, 20 bp, Artificial Sequence
  sgRNA
  NTC_2958
tatatggtggtcccgcgacg

SEQ ID NO: 67706 - DNA, 20 bp, Artificial Sequence
  sgRNA
  NTC_2959
gcgagtagagacgtcgcttc

SEQ ID NO: 67707 - DNA, 20 bp, Artificial Sequence
  sgRNA
  NTC_2960
ttcgagaacgctcgagaaca

SEQ ID NO: 67708 - DNA, 20 bp, Artificial Sequence
  sgRNA
  NTC_2961
atgagggcaacgaacgtcat

SEQ ID NO: 67709 - DNA, 20 bp, Artificial Sequence
  sgRNA
  NTC_2962
gttacgggcgacgcgtacga

SEQ ID NO: 67710 - DNA, 20 bp, Artificial Sequence
  sgRNA
  NTC_2963
tctcaggacgtgtcgcgtcg

SEQ ID NO: 67711 - DNA, 20 bp, Artificial Sequence
  sgRNA
  NTC_2964
ggcgacgcgggcgattctac

SEQ ID NO: 67712 - DNA, 20 bp, Artificial Sequence
  sgRNA
  NTC_2965
gctcgattaagcaaaagcgc

SEQ ID NO: 67713 - DNA, 20 bp, Artificial Sequence
  sgRNA
  NTC_2966
tggcgacacgacgatcgact

SEQ ID NO: 67714 - DNA, 20 bp, Artificial Sequence
  sgRNA
  NTC_2967
atacgttgtcggcgcctatg

SEQ ID NO: 67715 - DNA, 20 bp, Artificial Sequence
  sgRNA
  NTC_2968
ctatacgtgtatcctatcgc

SEQ ID NO: 67716 - DNA, 20 bp, Artificial Sequence
  sgRNA
  NTC_2969
tagatataatcgcccgcata

SEQ ID NO: 67717 - DNA, 20 bp, Artificial Sequence
  sgRNA
  NTC_2970
gcgctctgtcgacccgattc

SEQ ID NO: 67718 - DNA, 20 bp, Artificial Sequence
  sgRNA
  NTC_2971
tagcgtcacggaccgtcaat

SEQ ID NO: 67719 - DNA, 20 bp, Artificial Sequence
  sgRNA
  NTC_2972
actagttgagtgacgccgcc

SEQ ID NO: 67720 - DNA, 20 bp, Artificial Sequence
  sgRNA
  NTC_2973
gggctcgaatctcgcacgac

SEQ ID NO: 67721 - DNA, 20 bp, Artificial Sequence
  sgRNA
  NTC_2974
gcgcgtagaactctacgatt

SEQ ID NO: 67722 - DNA, 20 bp, Artificial Sequence
  sgRNA
  NTC_2975
gtgcggcgttcatagccgtt

SEQ ID NO: 67723 - DNA, 20 bp, Artificial Sequence
  sgRNA
  NTC_2976
gttctcacggcgcgattcta

SEQ ID NO: 67724 - DNA, 20 bp, Artificial Sequence
  sgRNA
  NTC_2977
ggaacgcttacgacgtcgaa

SEQ ID NO: 67725 - DNA, 20 bp, Artificial Sequence
  sgRNA
  NTC_2978
actcgtatgtgagacgtcga

SEQ ID NO: 67726 - DNA, 20 bp, Artificial Sequence
  sgRNA
  NTC_2979
taattcttgttccgtcgtcg

SEQ ID NO: 67727 - DNA, 20 bp, Artificial Sequence
  sgRNA
  NTC_2980
tgcttaacgttgattccgcg

SEQ ID NO: 67728 - DNA, 20 bp, Artificial Sequence
  sgRNA
  NTC_2981
tctaataactatcgtcgaac

SEQ ID NO: 67729 - DNA, 20 bp, Artificial Sequence
  sgRNA
  NTC_2982
tgttacttacggcgcacgtc

SEQ ID NO: 67730 - DNA, 20 bp, Artificial Sequence
  sgRNA
  NTC_2983
gtgcgcatcgacgcgcgcct

SEQ ID NO: 67731 - DNA, 20 bp, Artificial Sequence
  sgRNA
  NTC_2984
atctatatggaacgtccgtc

SEQ ID NO: 67732 - DNA, 20 bp, Artificial Sequence
  sgRNA
  NTC_2985
aacggaaatacgaccgcgct

SEQ ID NO: 67733 - DNA, 20 bp, Artificial Sequence
  sgRNA
  NTC_2986
gacggaacgtacctcgcgtt

SEQ ID NO: 67734 - DNA, 20 bp, Artificial Sequence
  sgRNA
  NTC_2987
aggtgattgtcgcgcgcgca

SEQ ID NO: 67735 - DNA, 20 bp, Artificial Sequence
  sgRNA
  NTC_2988
atcgaatcgtctagctagtc

SEQ ID NO: 67736 - DNA, 20 bp, Artificial Sequence
  sgRNA
  NTC_2989
tgtaggcgattccgaacgac

SEQ ID NO: 67737 - DNA, 20 bp, Artificial Sequence
  sgRNA
  NTC_2990
cacacgcaacgcatcgctct

SEQ ID NO: 67738 - DNA, 20 bp, Artificial Sequence
  sgRNA
  NTC_2991
acggtcgtaacgataagttc

SEQ ID NO: 67739 - DNA, 20 bp, Artificial Sequence
  sgRNA
  NTC_2992
agagcgagtcacgtcgtgcg

SEQ ID NO: 67740 - DNA, 20 bp, Artificial Sequence
  sgRNA
  NTC_2993
tcgtgacggtacgaaaacct

SEQ ID NO: 67741 - DNA, 20 bp, Artificial Sequence
  sgRNA
  NTC_2994
caacgtcggcaacgcgtgag

SEQ ID NO: 67742 - DNA, 20 bp, Artificial Sequence
  sgRNA
  NTC_2995
gcgtgcgctggctaagcgat

SEQ ID NO: 67743 - DNA, 20 bp, Artificial Sequence
  sgRNA
  NTC_2996
ggatcaatggacaccgcgtg

SEQ ID NO: 67744 - DNA, 20 bp, Artificial Sequence
  sgRNA
  NTC_2997
aatggacaataaccgtgtcg

SEQ ID NO: 67745 - DNA, 20 bp, Artificial Sequence
  sgRNA
  NTC_2998
tacggcactatactcgcgca

SEQ ID NO: 67746 - DNA, 20 bp, Artificial Sequence
  sgRNA
  NTC_2999
atcgcgtggcgtcgacctat

SEQ ID NO: 67747 - DNA, 20 bp, Artificial Sequence
  sgRNA
  NTC_3000
gtttgctggtatagcgccaa

SEQ ID NO: 67748 - DNA, 20 bp, Artificial Sequence
  sgRNA
  NTC_3001
ctcaatgtagcgcagcgtag

SEQ ID NO: 67749 - DNA, 20 bp, Artificial Sequence
  sgRNA
  NTC_3002
gtgctcaggttgcgcacatc

SEQ ID NO: 67750 - DNA, 20 bp, Artificial Sequence
  sgRNA
  NTC_3003
tgatggctacttgcgtcgat

SEQ ID NO: 67751 - DNA, 20 bp, Artificial Sequence
  sgRNA
  NTC_3004
tcgcgatgtaaccccgattg

SEQ ID NO: 67752 - DNA, 20 bp, Artificial Sequence
  sgRNA
  NTC_3005
ggatcggcgcaccatcgatc

SEQ ID NO: 67753 - DNA, 20 bp, Artificial Sequence
  sgRNA
  NTC_3006
tcggtgcggatccgcgagtt

SEQ ID NO: 67754 - DNA, 20 bp, Artificial Sequence
  sgRNA
  NTC_3007
gaggacatcgcgcgcttagc

SEQ ID NO: 67755 - DNA, 20 bp, Artificial Sequence
  sgRNA
  NTC_3008
attctgattagcgcgcgcgt

SEQ ID NO: 67756 - DNA, 20 bp, Artificial Sequence
  sgRNA
  NTC_3009
atcgtcagcgacgcaacacg

SEQ ID NO: 67757 - DNA, 20 bp, Artificial Sequence
  sgRNA
  NTC_3010
agataaggatatatcccgcg

SEQ ID NO: 67758 - DNA, 20 bp, Artificial Sequence
  sgRNA
  NTC_3011
ttgagcgtaaacaccgcgag

SEQ ID NO: 67759 - DNA, 20 bp, Artificial Sequence
  sgRNA
  NTC_3012
acgtggggacacgctaatct

SEQ ID NO: 67760 - DNA, 20 bp, Artificial Sequence
  sgRNA
  NTC_3013
gacgctaatattgacgctcg

SEQ ID NO: 67761 - DNA, 20 bp, Artificial Sequence
  sgRNA
  NTC_3014
gagatcagttaacgcgtatt

SEQ ID NO: 67762 - DNA, 20 bp, Artificial Sequence
  sgRNA
  NTC_3015
tcggttgggatcgcgtcaca

SEQ ID NO: 67763 - DNA, 20 bp, Artificial Sequence
  sgRNA
  NTC_3016
atatcgatctcgaagcgcga

SEQ ID NO: 67764 - DNA, 20 bp, Artificial Sequence
  sgRNA
  NTC_3017
cgctcttcgcacactacgtc

SEQ ID NO: 67765 - DNA, 20 bp, Artificial Sequence
  sgRNA
  NTC_3018
acgcggacaatgcgtcatta

SEQ ID NO: 67766 - DNA, 20 bp, Artificial Sequence
  sgRNA
  NTC_3019
ggcgtgtacgtaataaccta

SEQ ID NO: 67767 - DNA, 20 bp, Artificial Sequence
  sgRNA
  NTC_3020
agcgcagctgtatactgcgt

SEQ ID NO: 67768 - DNA, 20 bp, Artificial Sequence
  sgRNA
  NTC_3021
gactggtcattcctcgttac

SEQ ID NO: 67769 - DNA, 20 bp, Artificial Sequence
  sgRNA
  NTC_3022
tacggcataagcgctgcgtc

SEQ ID NO: 67770 - DNA, 20 bp, Artificial Sequence
  sgRNA
  NTC_3023
gctggtatggtatccgccac

SEQ ID NO: 67771 - DNA, 20 bp, Artificial Sequence
  sgRNA
  NTC_3024
cggcgtaatcggttaagcgt

SEQ ID NO: 67772 - DNA, 20 bp, Artificial Sequence
  sgRNA
  NTC_3025
aaaacttatctcgactacgc

SEQ ID NO: 67773 - DNA, 20 bp, Artificial Sequence
  sgRNA
  NTC_3026
ggtgggcgaacgagcgtccc

SEQ ID NO: 67774 - DNA, 20 bp, Artificial Sequence
  sgRNA
  NTC_3027
atatagtaggcgacatcgtc

SEQ ID NO: 67775 - DNA, 20 bp, Artificial Sequence
  sgRNA
  NTC_3028
acggctcgctgactaatatc

SEQ ID NO: 67776 - DNA, 20 bp, Artificial Sequence
  sgRNA
  NTC_3029
gcgcgtattctaaccgatcc

SEQ ID NO: 67777 - DNA, 20 bp, Artificial Sequence
  sgRNA
  NTC_3030
ggttgtatgtcgcgtagtcg

SEQ ID NO: 67778 - DNA, 20 bp, Artificial Sequence
  sgRNA
  NTC_3031
gcggattagtaagagtcgag

SEQ ID NO: 67779 - DNA, 20 bp, Artificial Sequence
  sgRNA
  NTC_3032
acggcgtcggggtactatat

SEQ ID NO: 67780 - DNA, 20 bp, Artificial Sequence
  sgRNA
  NTC_3033
ttcgcggcggttgaaaaatc

SEQ ID NO: 67781 - DNA, 20 bp, Artificial Sequence
  sgRNA
  NTC_3034
tcgctcattaggttccgtag

SEQ ID NO: 67782 - DNA, 20 bp, Artificial Sequence
  sgRNA
  NTC_3035
taggggggcgctcgcgttaa

SEQ ID NO: 67783 - DNA, 20 bp, Artificial Sequence
  sgRNA
  NTC_3036
gtagtgatttggcgcctatt

SEQ ID NO: 67784 - DNA, 20 bp, Artificial Sequence
  sgRNA
  NTC_3037
tcatctagcggtgtcgatta

SEQ ID NO: 67785 - DNA, 20 bp, Artificial Sequence
  sgRNA
  NTC_3038
gttgatcaagaatcgccgcc

SEQ ID NO: 67786 - DNA, 20 bp, Artificial Sequence
  sgRNA
  NTC_3039
cgctaaacggcgactctata

SEQ ID NO: 67787 - DNA, 20 bp, Artificial Sequence
  sgRNA
  NTC_3040
tctctgcgttcgtcgaacga

SEQ ID NO: 67788 - DNA, 20 bp, Artificial Sequence
  sgRNA
  NTC_3041
tcatgtcggctgctcgactc

SEQ ID NO: 67789 - DNA, 20 bp, Artificial Sequence
  sgRNA
  NTC_3042
catcgcgcgcgatcagctag

SEQ ID NO: 67790 - DNA, 20 bp, Artificial Sequence
  sgRNA
  NTC_3043
tcggtggtacacctcgacca

SEQ ID NO: 67791 - DNA, 20 bp, Artificial Sequence
  sgRNA
  NTC_3044
cgcgcgaacatccgcaatgt

SEQ ID NO: 67792 - DNA, 20 bp, Artificial Sequence
  sgRNA
  NTC_3045
tctctgcatgcgagtacgat

SEQ ID NO: 67793 - DNA, 20 bp, Artificial Sequence
  sgRNA
  NTC_3046
caaacgcttgacgcgtttat

SEQ ID NO: 67794 - DNA, 20 bp, Artificial Sequence
  sgRNA
  NTC_3047
tcggtcggcgcaaacgcacc

SEQ ID NO: 67795 - DNA, 20 bp, Artificial Sequence
  sgRNA
  NTC_3048
gtacgacggcgccacgcatt

SEQ ID NO: 67796 - DNA, 20 bp, Artificial Sequence
  sgRNA
  NTC_3049
atgcaaaggggaatccgtta

SEQ ID NO: 67797 - DNA, 20 bp, Artificial Sequence
  sgRNA
  NTC_3050
ttcgtgcgcgcgttaacgtt

SEQ ID NO: 67798 - DNA, 20 bp, Artificial Sequence
  sgRNA
  NTC_3051
tctatgttgtcgacccgatc

SEQ ID NO: 67799 - DNA, 20 bp, Artificial Sequence
  sgRNA
  NTC_3052
caaatcggctgcgtcgatcg

SEQ ID NO: 67800 - DNA, 20 bp, Artificial Sequence
  sgRNA
  NTC_3053
ggtcggcgagcgcaacgata

SEQ ID NO: 67801 - DNA, 20 bp, Artificial Sequence
  sgRNA
  NTC_3054
gcgtattcggtccgtcctgt

SEQ ID NO: 67802 - DNA, 20 bp, Artificial Sequence
  sgRNA
  NTC_3055
ggtactcaacgtccgccgaa

SEQ ID NO: 67803 - DNA, 20 bp, Artificial Sequence
  sgRNA
  NTC_3056
attgttatgagatccgtcat

SEQ ID NO: 67804 - DNA, 20 bp, Artificial Sequence
  sgRNA
  NTC_3057
gcgcaacgtaacacgcaagc

SEQ ID NO: 67805 - DNA, 20 bp, Artificial Sequence
  sgRNA
  NTC_3058
cggtcgacgtaaagcgagtg

SEQ ID NO: 67806 - DNA, 20 bp, Artificial Sequence
  sgRNA
  NTC_3059
tcgaacgtgttacgcaaaag

SEQ ID NO: 67807 - DNA, 20 bp, Artificial Sequence
  sgRNA
  NTC_3060
tgtcgcgcgtattcgtgtta

SEQ ID NO: 67808 - DNA, 20 bp, Artificial Sequence
  sgRNA
  NTC_3061
gtgcgtaaaatcgcctacgc

SEQ ID NO: 67809 - DNA, 20 bp, Artificial Sequence
  sgRNA
  NTC_3062
ttcggctaactaacgacact

SEQ ID NO: 67810 - DNA, 20 bp, Artificial Sequence
  sgRNA
  NTC_3063
agaggtttcggtaacgtcgt

SEQ ID NO: 67811 - DNA, 20 bp, Artificial Sequence
  sgRNA
  NTC_3064
gcacaatacatcgatcgcgt

SEQ ID NO: 67812 - DNA, 20 bp, Artificial Sequence
  sgRNA
  NTC_3065
tatgtggcgtgaccgtcctc

SEQ ID NO: 67813 - DNA, 20 bp, Artificial Sequence
  sgRNA
  NTC_3066
ttgcgctgttataccgaagt

SEQ ID NO: 67814 - DNA, 20 bp, Artificial Sequence
  sgRNA
  NTC_3067
cgacttgcgcggtcgactct

SEQ ID NO: 67815 - DNA, 20 bp, Artificial Sequence
  sgRNA
  NTC_3068
gtcgatacgtcgctgaaacg

SEQ ID NO: 67816 - DNA, 20 bp, Artificial Sequence
  sgRNA
  NTC_3069
tcgtcgtcgctgccatgtac

SEQ ID NO: 67817 - DNA, 20 bp, Artificial Sequence
  sgRNA
  NTC_3070
cgcgtgcacgttaacccgtg

SEQ ID NO: 67818 - DNA, 20 bp, Artificial Sequence
  sgRNA
  NTC_3071
ggcgggattgcgatacgagc

SEQ ID NO: 67819 - DNA, 20 bp, Artificial Sequence
  sgRNA
  NTC_3072
cttcgcacggataatgcgac

SEQ ID NO: 67820 - DNA, 20 bp, Artificial Sequence
  sgRNA
  NTC_3073
tgcgtcgcaagcccgacatg

SEQ ID NO: 67821 - DNA, 20 bp, Artificial Sequence
  sgRNA
  NTC_3074
tgagcgcgcaggcgtaatgt

SEQ ID NO: 67822 - DNA, 20 bp, Artificial Sequence
  sgRNA
  NTC_3075
acgcactcgtgacgctcaat

SEQ ID NO: 67823 - DNA, 20 bp, Artificial Sequence
  sgRNA
  NTC_3076
tacgcacactcgtgcgtcgt

SEQ ID NO: 67824 - DNA, 20 bp, Artificial Sequence
  sgRNA
  NTC_3077
cgcttgcgcagttgacccga

SEQ ID NO: 67825 - DNA, 20 bp, Artificial Sequence
  sgRNA
  NTC_3078
gtcggtaattgccccgccat

SEQ ID NO: 67826 - DNA, 20 bp, Artificial Sequence
  sgRNA
  NTC_3079
atttaatatgcgtccgccgc

SEQ ID NO: 67827 - DNA, 20 bp, Artificial Sequence
  sgRNA
  NTC_3080
tatgcgctacaccatcgtta

SEQ ID NO: 67828 - DNA, 20 bp, Artificial Sequence
  sgRNA
  NTC_3081
tcgtgacggttagctcgtga

SEQ ID NO: 67829 - DNA, 20 bp, Artificial Sequence
  sgRNA
  NTC_3082
cgtgtagttgtatgcgagcg

SEQ ID NO: 67830 - DNA, 20 bp, Artificial Sequence
  sgRNA
  NTC_3083
cgggcgagctgtcgataaag

SEQ ID NO: 67831 - DNA, 20 bp, Artificial Sequence
  sgRNA
  NTC_3084
taacgctagtctccgcttag

SEQ ID NO: 67832 - DNA, 20 bp, Artificial Sequence
  sgRNA
  NTC_3085
atcgacgctttacgttacta

SEQ ID NO: 67833 - DNA, 20 bp, Artificial Sequence
  sgRNA
  NTC_3086
ggtcgtggatgagcgctaat

SEQ ID NO: 67834 - DNA, 20 bp, Artificial Sequence
  sgRNA
  NTC_3087
cttcgacgcggacacgtatc

SEQ ID NO: 67835 - DNA, 20 bp, Artificial Sequence
  sgRNA
  NTC_3088
ggcgctagacgcaatcgata

SEQ ID NO: 67836 - DNA, 20 bp, Artificial Sequence
  sgRNA
  NTC_3089
cggggagacgcatcgtaaca

SEQ ID NO: 67837 - DNA, 20 bp, Artificial Sequence
  sgRNA
  NTC_3090
ggggtagattggatcccgtt

SEQ ID NO: 67838 - DNA, 20 bp, Artificial Sequence
  sgRNA
  NTC_3091
tggaacggcacgcttatcgc

SEQ ID NO: 67839 - DNA, 20 bp, Artificial Sequence
  sgRNA
  NTC_3092
cggtgttcgggcaacgagtg

SEQ ID NO: 67840 - DNA, 20 bp, Artificial Sequence
  sgRNA
  NTC_3093
ctggacgcggtgtgcgattg

SEQ ID NO: 67841 - DNA, 20 bp, Artificial Sequence
  sgRNA
  NTC_3094
agttctaagtctcgcccgct

SEQ ID NO: 67842 - DNA, 20 bp, Artificial Sequence
  sgRNA
  NTC_3095
agttgttcgggtactctatc

SEQ ID NO: 67843 - DNA, 20 bp, Artificial Sequence
  sgRNA
  NTC_3096
gtttatcatttgatcgcgac

SEQ ID NO: 67844 - DNA, 20 bp, Artificial Sequence
  sgRNA
  NTC_3097
gggggtgatcaacgtatcgc

SEQ ID NO: 67845 - DNA, 20 bp, Artificial Sequence
  sgRNA
  NTC_3098
atcgtcaatcgtacgttacg

SEQ ID NO: 67846 - DNA, 20 bp, Artificial Sequence
  sgRNA
  NTC_3099
cacgaggtttctacgccgaa

SEQ ID NO: 67847 - DNA, 20 bp, Artificial Sequence
  sgRNA
  NTC_3100
tggagacgtgagccgcgtac

SEQ ID NO: 67848 - DNA, 20 bp, Artificial Sequence
  sgRNA
  NTC_3101
agaaagggttcgccctacgt

SEQ ID NO: 67849 - DNA, 20 bp, Artificial Sequence
  sgRNA
  NTC_3102
ataggagcgcacgcaactac

SEQ ID NO: 67850 - DNA, 20 bp, Artificial Sequence
  sgRNA
  NTC_3103
cgtgggagttatcgtcacgc

SEQ ID NO: 67851 - DNA, 20 bp, Artificial Sequence
  sgRNA
  NTC_3104
gacatacgctagccgccgat

SEQ ID NO: 67852 - DNA, 20 bp, Artificial Sequence
  sgRNA
  NTC_3105
gcggaataattcttcgaacc

SEQ ID NO: 67853 - DNA, 20 bp, Artificial Sequence
  sgRNA
  NTC_3106
tctttgacggcgcgcgtcgc

SEQ ID NO: 67854 - DNA, 20 bp, Artificial Sequence
  sgRNA
  NTC_3107
acgcgatattcgcgagtcac

SEQ ID NO: 67855 - DNA, 20 bp, Artificial Sequence
  sgRNA
  NTC_3108
tttcgttaagattaagcgcg

SEQ ID NO: 67856 - DNA, 20 bp, Artificial Sequence
  sgRNA
  NTC_3109
tggatgacacgcatcgaccg

SEQ ID NO: 67857 - DNA, 20 bp, Artificial Sequence
  sgRNA
  NTC_3110
acgcacacgactcctcgcct

SEQ ID NO: 67858 - DNA, 20 bp, Artificial Sequence
  sgRNA
  NTC_3111
aatcatgtgtatcgtcgcat

SEQ ID NO: 67859 - DNA, 20 bp, Artificial Sequence
  sgRNA
  NTC_3112
ctttcgggtcactccgagct

SEQ ID NO: 67860 - DNA, 20 bp, Artificial Sequence
  sgRNA
  NTC_3113
ttgttgagattccgcgcaca

SEQ ID NO: 67861 - DNA, 20 bp, Artificial Sequence
  sgRNA
  NTC_3114
gtagcggctcggaacgatcg

SEQ ID NO: 67862 - DNA, 20 bp, Artificial Sequence
  sgRNA
  NTC_3115
actggtcgcgagtatcgtat

SEQ ID NO: 67863 - DNA, 20 bp, Artificial Sequence
  sgRNA
  NTC_3116
gcggtgcagcgcaacccgtt

SEQ ID NO: 67864 - DNA, 20 bp, Artificial Sequence
  sgRNA
  NTC_3117
cgtgcgttaaatgtcgcacg

SEQ ID NO: 67865 - DNA, 20 bp, Artificial Sequence
  sgRNA
  NTC_3118
acgggagggttatccgaacg

SEQ ID NO: 67866 - DNA, 20 bp, Artificial Sequence
  sgRNA
  NTC_3119
gctataatacggtcgcagtt

SEQ ID NO: 67867 - DNA, 20 bp, Artificial Sequence
  sgRNA
  NTC_3120
cgcgggcgggtaccgaactt

SEQ ID NO: 67868 - DNA, 20 bp, Artificial Sequence
  sgRNA
  NTC_3121
gctaacatcgctcgccgatt

SEQ ID NO: 67869 - DNA, 20 bp, Artificial Sequence
  sgRNA
  NTC_3122
gatggtgcttatgccgcgtt

SEQ ID NO: 67870 - DNA, 20 bp, Artificial Sequence
  sgRNA
  NTC_3123
acggtgcatcgtccgtacat

SEQ ID NO: 67871 - DNA, 20 bp, Artificial Sequence
  sgRNA
  NTC_3124
tcatcgcggcgtgcgtagac

SEQ ID NO: 67872 - DNA, 20 bp, Artificial Sequence
  sgRNA
  NTC_3125
gtcgctcggaagcgtcgata

SEQ ID NO: 67873 - DNA, 20 bp, Artificial Sequence
  sgRNA
  NTC_3126
gatcgactagtgcatgacgc

SEQ ID NO: 67874 - DNA, 20 bp, Artificial Sequence
  sgRNA
  NTC_3127
gtgcgacggatcattctgct

SEQ ID NO: 67875 - DNA, 20 bp, Artificial Sequence
  sgRNA
  NTC_3128
gttcgttaacgtaacgtcgc

SEQ ID NO: 67876 - DNA, 20 bp, Artificial Sequence
  sgRNA
  NTC_3129
agtcgattaacgactattcc

SEQ ID NO: 67877 - DNA, 20 bp, Artificial Sequence
  sgRNA
  NTC_3130
acgatatgtagagcgttacg

SEQ ID NO: 67878 - DNA, 20 bp, Artificial Sequence
  sgRNA
  NTC_3131
aataggctcgcgcatcgtcc

SEQ ID NO: 67879 - DNA, 20 bp, Artificial Sequence
  sgRNA
  NTC_3132
ctgggcgtacaccttacgag

SEQ ID NO: 67880 - DNA, 20 bp, Artificial Sequence
  sgRNA
  NTC_3133
acggctcgagatacgatact

SEQ ID NO: 67881 - DNA, 20 bp, Artificial Sequence
  sgRNA
  NTC_3134
caggcgtattcaaacgcgcg

SEQ ID NO: 67882 - DNA, 20 bp, Artificial Sequence
  sgRNA
  NTC_3135
tcagcgacgtaaccgcacct

SEQ ID NO: 67883 - DNA, 20 bp, Artificial Sequence
  sgRNA
  NTC_3136
cttacgctctgacgctcgtt

SEQ ID NO: 67884 - DNA, 20 bp, Artificial Sequence
  sgRNA
  NTC_3137
tagaggtcgcgtacgtgctt

SEQ ID NO: 67885 - DNA, 20 bp, Artificial Sequence
  sgRNA
  NTC_3138
tcagattgtaggcgcgacat

SEQ ID NO: 67886 - DNA, 20 bp, Artificial Sequence
  sgRNA
  NTC_3139
ggcggaaatcgccgcgtcat

SEQ ID NO: 67887 - DNA, 20 bp, Artificial Sequence
  sgRNA
  NTC_3140
cacgtgcgacataagctacg

SEQ ID NO: 67888 - DNA, 20 bp, Artificial Sequence
  sgRNA
  NTC_3141
gactatacagtccgcgctag

SEQ ID NO: 67889 - DNA, 20 bp, Artificial Sequence
  sgRNA
  NTC_3142
gcgggctagtaaattacgcg

SEQ ID NO: 67890 - DNA, 20 bp, Artificial Sequence
  sgRNA
  NTC_3143
aagctcgcggaccgagacga

SEQ ID NO: 67891 - DNA, 20 bp, Artificial Sequence
  sgRNA
  NTC_3144
tcgctgtagtggacgaatcc

SEQ ID NO: 67892 - DNA, 20 bp, Artificial Sequence
  sgRNA
  NTC_3145
aggctacatcacgcctccgt

SEQ ID NO: 67893 - DNA, 20 bp, Artificial Sequence
  sgRNA
  NTC_3146
attcgagctcgacgccgtga

SEQ ID NO: 67894 - DNA, 20 bp, Artificial Sequence
  sgRNA
  NTC_3147
gagtcagtctattgcgatct

SEQ ID NO: 67895 - DNA, 20 bp, Artificial Sequence
  sgRNA
  NTC_3148
cgactggggtcgtccgatag

SEQ ID NO: 67896 - DNA, 20 bp, Artificial Sequence
  sgRNA
  NTC_3149
ttagataatcgctgaacgcg

SEQ ID NO: 67897 - DNA, 20 bp, Artificial Sequence
  sgRNA
  NTC_3150
acattcatatacgcgatcgc

SEQ ID NO: 67898 - DNA, 20 bp, Artificial Sequence
  sgRNA
  NTC_3151
gtcaaagcgcgcgatcgtat

SEQ ID NO: 67899 - DNA, 20 bp, Artificial Sequence
  sgRNA
  NTC_3152
ctcgactacgagtcgcgaac

SEQ ID NO: 67900 - DNA, 20 bp, Artificial Sequence
  sgRNA
  NTC_3153
ctcgttgaggcatcaccgac

SEQ ID NO: 67901 - DNA, 20 bp, Artificial Sequence
  sgRNA
  NTC_3154
tcgcaggtcgatttcgccat

SEQ ID NO: 67902 - DNA, 20 bp, Artificial Sequence
  sgRNA
  NTC_3155
gcgcgacgtgcttcgccgat

SEQ ID NO: 67903 - DNA, 20 bp, Artificial Sequence
  sgRNA
  NTC_3156
tggtcgtacaaaccccgcga

SEQ ID NO: 67904 - DNA, 20 bp, Artificial Sequence
  sgRNA
  NTC_3157
cgaatattctcacgttctcg

SEQ ID NO: 67905 - DNA, 20 bp, Artificial Sequence
  sgRNA
  NTC_3158
ataagtgtacgagccgacgt

SEQ ID NO: 67906 - DNA, 20 bp, Artificial Sequence
  sgRNA
  NTC_3159
gcgatctgcattgtgcgcgt

SEQ ID NO: 67907 - DNA, 20 bp, Artificial Sequence
  sgRNA
  NTC_3160
ttcgagggcaactccaatac

SEQ ID NO: 67908 - DNA, 20 bp, Artificial Sequence
  sgRNA
  NTC_3161
attagctcgcgattccccgt

SEQ ID NO: 67909 - DNA, 20 bp, Artificial Sequence
  sgRNA
  NTC_3162
attatcgtgttcgcgccact

SEQ ID NO: 67910 - DNA, 20 bp, Artificial Sequence
  sgRNA
  NTC_3163
gggtttaaatgtcgtacgtc

SEQ ID NO: 67911 - DNA, 20 bp, Artificial Sequence
  sgRNA
  NTC_3164
tagcgttatgcgtgaaaact

SEQ ID NO: 67912 - DNA, 20 bp, Artificial Sequence
  sgRNA
  NTC_3165
aaatcgactacgcgatgcgt

SEQ ID NO: 67913 - DNA, 20 bp, Artificial Sequence
  sgRNA
  NTC_3166
ggttgcttacgttcgcgctt

SEQ ID NO: 67914 - DNA, 20 bp, Artificial Sequence
  sgRNA
  NTC_3167
gaggcactcggtaacgaatc

SEQ ID NO: 67915 - DNA, 20 bp, Artificial Sequence
  sgRNA
  NTC_3168
actggtatacttccgcgtcg

SEQ ID NO: 67916 - DNA, 20 bp, Artificial Sequence
  sgRNA
  NTC_3169
gtcttggagcataccgagca

SEQ ID NO: 67917 - DNA, 20 bp, Artificial Sequence
  sgRNA
  NTC_3170
tgacgagttgcgcgcagtta

SEQ ID NO: 67918 - DNA, 20 bp, Artificial Sequence
  sgRNA
  NTC_3171
tgtggagtcgctatccgacg

SEQ ID NO: 67919 - DNA, 20 bp, Artificial Sequence
  sgRNA
  NTC_3172
gacgaaacgtgcgagaaccc

SEQ ID NO: 67920 - DNA, 20 bp, Artificial Sequence
  sgRNA
  NTC_3173
ctgcatgcgtaatcgttgac

SEQ ID NO: 67921 - DNA, 20 bp, Artificial Sequence
  sgRNA
  NTC_3174
cgacgctagtaccgcgctta

SEQ ID NO: 67922 - DNA, 20 bp, Artificial Sequence
  sgRNA
  NTC_3175
cggacagcgtatgtctcgaa

SEQ ID NO: 67923 - DNA, 20 bp, Artificial Sequence
  sgRNA
  NTC_3176
tggcgtctcgtaaccgctat

SEQ ID NO: 67924 - DNA, 20 bp, Artificial Sequence
  sgRNA
  NTC_3177
gtatctgatagcgcgagcga

SEQ ID NO: 67925 - DNA, 20 bp, Artificial Sequence
  sgRNA
  NTC_3178
atagtggcgtaccgctcttc

SEQ ID NO: 67926 - DNA, 20 bp, Artificial Sequence
  sgRNA
  NTC_3179
cgggttatcgaaagcccgaa

SEQ ID NO: 67927 - DNA, 20 bp, Artificial Sequence
  sgRNA
  NTC_3180
ttctcgggcggtcgcgactt

SEQ ID NO: 67928 - DNA, 20 bp, Artificial Sequence
  sgRNA
  NTC_3181
ttacgatcagtcgcaaacga

SEQ ID NO: 67929 - DNA, 20 bp, Artificial Sequence
  sgRNA
  NTC_3182
cgtcgaacgcgacgtgcgaa

SEQ ID NO: 67930 - DNA, 20 bp, Artificial Sequence
  sgRNA
  NTC_3183
catgatcaatatctcgatcg

SEQ ID NO: 67931 - DNA, 20 bp, Artificial Sequence
  sgRNA
  NTC_3184
ttcgtttcgttccgcccgac

SEQ ID NO: 67932 - DNA, 20 bp, Artificial Sequence
  sgRNA
  NTC_3185
cgcacgcatcgtcgacttgc

SEQ ID NO: 67933 - DNA, 20 bp, Artificial Sequence
  sgRNA
  NTC_3186
tcggttcgggattccgcaac

SEQ ID NO: 67934 - DNA, 20 bp, Artificial Sequence
  sgRNA
  NTC_3187
acgcttgacgcacccgaaca

SEQ ID NO: 67935 - DNA, 20 bp, Artificial Sequence
  sgRNA
  NTC_3188
cacgttgacgctacgcatat

SEQ ID NO: 67936 - DNA, 20 bp, Artificial Sequence
  sgRNA
  NTC_3189
ttagcttcgatgcacgcgtc

SEQ ID NO: 67937 - DNA, 20 bp, Artificial Sequence
  sgRNA
  NTC_3190
ggatagctgtaacgcgtcgt

SEQ ID NO: 67938 - DNA, 20 bp, Artificial Sequence
  sgRNA
  NTC_3191
atcgaatcttcgacgacacg

SEQ ID NO: 67939 - DNA, 20 bp, Artificial Sequence
  sgRNA
  NTC_3192
tctataatgcgacccgtacc

SEQ ID NO: 67940 - DNA, 20 bp, Artificial Sequence
  sgRNA
  NTC_3193
gagtgtagacgtcgcacgaa

SEQ ID NO: 67941 - DNA, 20 bp, Artificial Sequence
  sgRNA
  NTC_3194
cggtcgttactgtatgcgag

SEQ ID NO: 67942 - DNA, 20 bp, Artificial Sequence
  sgRNA
  NTC_3195
ctgatatcgggcacgactac

SEQ ID NO: 67943 - DNA, 20 bp, Artificial Sequence
  sgRNA
  NTC_3196
atcgggcggtgacgcgcata

SEQ ID NO: 67944 - DNA, 20 bp, Artificial Sequence
  sgRNA
  NTC_3197
tcgtcaaacgcgttcatacg

SEQ ID NO: 67945 - DNA, 20 bp, Artificial Sequence
  sgRNA
  NTC_3198
tgagtgttgacgcgagttaa

SEQ ID NO: 67946 - DNA, 20 bp, Artificial Sequence
  sgRNA
  NTC_3199
ctcgtatatcgtgcgaagtt

SEQ ID NO: 67947 - DNA, 20 bp, Artificial Sequence
  sgRNA
  NTC_3200
cgtctcgcggttatcagatc

SEQ ID NO: 67948 - DNA, 20 bp, Artificial Sequence
  sgRNA
  NTC_3201
gcggaggttgcgtatttacc

SEQ ID NO: 67949 - DNA, 20 bp, Artificial Sequence
  sgRNA
  NTC_3202
ttcggttagcggtctaagtt

SEQ ID NO: 67950 - DNA, 20 bp, Artificial Sequence
  sgRNA
  NTC_3203
ttcgttggacgacaaccgat

SEQ ID NO: 67951 - DNA, 20 bp, Artificial Sequence
  sgRNA
  NTC_3204
cgtaggcacgctttcgtccg

SEQ ID NO: 67952 - DNA, 20 bp, Artificial Sequence
  sgRNA
  NTC_3205
tcggactcgggtacgttatt

SEQ ID NO: 67953 - DNA, 20 bp, Artificial Sequence
  sgRNA
  NTC_3206
cacgacacgttacgcctgtc

SEQ ID NO: 67954 - DNA, 20 bp, Artificial Sequence
  sgRNA
  NTC_3207
aagaatgcgtagagcgcacg

SEQ ID NO: 67955 - DNA, 20 bp, Artificial Sequence
  sgRNA
  NTC_3208
acgcgtatctcgacccgcta

SEQ ID NO: 67956 - DNA, 20 bp, Artificial Sequence
  sgRNA
  NTC_3209
tcgaatgttcgcgaacgaca

SEQ ID NO: 67957 - DNA, 20 bp, Artificial Sequence
  sgRNA
  NTC_3210
atcactgcgaggtgtcgctc

SEQ ID NO: 67958 - DNA, 20 bp, Artificial Sequence
  sgRNA
  NTC_3211
catgctcgcgcgtatcgcat

SEQ ID NO: 67959 - DNA, 20 bp, Artificial Sequence
  sgRNA
  NTC_3212
ctgatatgtagacgcgccgt

SEQ ID NO: 67960 - DNA, 20 bp, Artificial Sequence
  sgRNA
  NTC_3213
gtgagactagcgctcgacta

SEQ ID NO: 67961 - DNA, 20 bp, Artificial Sequence
  sgRNA
  NTC_3214
atcgactcgttcgagtatag

SEQ ID NO: 67962 - DNA, 20 bp, Artificial Sequence
  sgRNA
  NTC_3215
tattaggcgtcgtaattgac

SEQ ID NO: 67963 - DNA, 20 bp, Artificial Sequence
  sgRNA
  NTC_3216
catcatacgctctacgtact

SEQ ID NO: 67964 - DNA, 20 bp, Artificial Sequence
  sgRNA
  NTC_3217
gcgcgttaaatcaacgccct

SEQ ID NO: 67965 - DNA, 20 bp, Artificial Sequence
  sgRNA
  NTC_3218
tgcttgcggagcgcccgttt

SEQ ID NO: 67966 - DNA, 20 bp, Artificial Sequence
  sgRNA
  NTC_3219
cactgcgcgaacgaacgtaa

SEQ ID NO: 67967 - DNA, 20 bp, Artificial Sequence
  sgRNA
  NTC_3220
ggctatatggcgcgcctcta

SEQ ID NO: 67968 - DNA, 20 bp, Artificial Sequence
  sgRNA
  NTC_3221
tgtcgaggagtcgatccacg

SEQ ID NO: 67969 - DNA, 20 bp, Artificial Sequence
  sgRNA
  NTC_3222
tctcggcggatcgtgcatag

SEQ ID NO: 67970 - DNA, 20 bp, Artificial Sequence
  sgRNA
  NTC_3223
cgcgtatgcggtaaacatcg

SEQ ID NO: 67971 - DNA, 20 bp, Artificial Sequence
  sgRNA
  NTC_3224
aacgcgcagataccgcgtcg

SEQ ID NO: 67972 - DNA, 20 bp, Artificial Sequence
  sgRNA
  NTC_3225
gttgggtttgcaaacgatac

SEQ ID NO: 67973 - DNA, 20 bp, Artificial Sequence
  sgRNA
  NTC_3226
ctgcgtatggcgtcgacccg

SEQ ID NO: 67974 - DNA, 20 bp, Artificial Sequence
  sgRNA
  NTC_3227
gagaacacgatacctgcgcg

SEQ ID NO: 67975 - DNA, 20 bp, Artificial Sequence
  sgRNA
  NTC_3228
tgcggaactagtccaaaacg

SEQ ID NO: 67976 - DNA, 20 bp, Artificial Sequence
  sgRNA
  NTC_3229
gagcaacgattgaacgatcc

SEQ ID NO: 67977 - DNA, 20 bp, Artificial Sequence
  sgRNA
  NTC_3230
gtcgatgcggggacatcgtt

SEQ ID NO: 67978 - DNA, 20 bp, Artificial Sequence
  sgRNA
  NTC_3231
actaagcgttatccgcgcat

SEQ ID NO: 67979 - DNA, 20 bp, Artificial Sequence
  sgRNA
  NTC_3232
gtgcagatctactcgaacta

SEQ ID NO: 67980 - DNA, 20 bp, Artificial Sequence
  sgRNA
  NTC_3233
tatcgctcgggctcttgcgt

SEQ ID NO: 67981 - DNA, 20 bp, Artificial Sequence
  sgRNA
  NTC_3234
tctatgtgacgttcgcgtcg

SEQ ID NO: 67982 - DNA, 20 bp, Artificial Sequence
  sgRNA
  NTC_3235
tgcagtcgatgcgcgtgatc

SEQ ID NO: 67983 - DNA, 20 bp, Artificial Sequence
  sgRNA
  NTC_3236
gttgaacaagcgcgttatgt

SEQ ID NO: 67984 - DNA, 20 bp, Artificial Sequence
  sgRNA
  NTC_3237
agatgtgaacgaacgacgcg

SEQ ID NO: 67985 - DNA, 20 bp, Artificial Sequence
  sgRNA
  NTC_3238
catacgacgcgcgattattg

SEQ ID NO: 67986 - DNA, 20 bp, Artificial Sequence
  sgRNA
  NTC_3239
gcgcgtcggacgacctgctt

SEQ ID NO: 67987 - DNA, 20 bp, Artificial Sequence
  sgRNA
  NTC_3240
atcgcgcattaacgctatat

SEQ ID NO: 67988 - DNA, 20 bp, Artificial Sequence
  sgRNA
  NTC_3241
cacggctatttacgcgttct

SEQ ID NO: 67989 - DNA, 20 bp, Artificial Sequence
  sgRNA
  NTC_3242
gcgggtggcgtacgcccttt

SEQ ID NO: 67990 - DNA, 20 bp, Artificial Sequence
  sgRNA
  NTC_3243
acgatgcacgacgctacgat

SEQ ID NO: 67991 - DNA, 20 bp, Artificial Sequence
  sgRNA
  NTC_3244
gctaagtgctactcgccgtt

SEQ ID NO: 67992 - DNA, 20 bp, Artificial Sequence
  sgRNA
  NTC_3245
cgcactcgacacgataaatc

SEQ ID NO: 67993 - DNA, 20 bp, Artificial Sequence
  sgRNA
  NTC_3246
agcggtcgcgcactcgatca

SEQ ID NO: 67994 - DNA, 20 bp, Artificial Sequence
  sgRNA
  NTC_3247
actaggcacgcgcccgcgaa

SEQ ID NO: 67995 - DNA, 20 bp, Artificial Sequence
  sgRNA
  NTC_3248
tgacagacggcgcccaaaat

SEQ ID NO: 67996 - DNA, 20 bp, Artificial Sequence
  sgRNA
  NTC_3249
gtgactgtcgtcctcatcgc

SEQ ID NO: 67997 - DNA, 20 bp, Artificial Sequence
  sgRNA
  NTC_3250
agatagcgtctagtcgcttt

SEQ ID NO: 67998 - DNA, 20 bp, Artificial Sequence
  sgRNA
  NTC_3251
acgcacgatttgcgtcacgc

SEQ ID NO: 67999 - DNA, 20 bp, Artificial Sequence
  sgRNA
  NTC_3252
atacttggggcgagtaccaa

SEQ ID NO: 68000 - DNA, 20 bp, Artificial Sequence
  sgRNA
  NTC_3253
cgtgacgttcgaccccataa

SEQ ID NO: 68001 - DNA, 20 bp, Artificial Sequence
  sgRNA
  NTC_3254
agctcgcgtagttacgataa

SEQ ID NO: 68002 - DNA, 20 bp, Artificial Sequence
  sgRNA
  NTC_3255
gaagataggacttgcaatcg

SEQ ID NO: 68003 - DNA, 20 bp, Artificial Sequence
  sgRNA
  NTC_3256
cgtacgcgtcgcagttcgca

SEQ ID NO: 68004 - DNA, 20 bp, Artificial Sequence
  sgRNA
  NTC_3257
tcgtagcgagtgcgcctata

SEQ ID NO: 68005 - DNA, 20 bp, Artificial Sequence
  sgRNA
  NTC_3258
cggcgaaatcgcgcgcgaca

SEQ ID NO: 68006 - DNA, 20 bp, Artificial Sequence
  sgRNA
  NTC_3259
ctacgatgagcgacgtcgac

SEQ ID NO: 68007 - DNA, 20 bp, Artificial Sequence
  sgRNA
  NTC_3260
aagcgcgtttaccgtatcgc

SEQ ID NO: 68008 - DNA, 20 bp, Artificial Sequence
  sgRNA
  NTC_3261
cggggtaaactgatccgaac

SEQ ID NO: 68009 - DNA, 20 bp, Artificial Sequence
  sgRNA
  NTC_3262
gatgaaaactttcgaccgta

SEQ ID NO: 68010 - DNA, 20 bp, Artificial Sequence
  sgRNA
  NTC_3263
ctgatgcggtctacgcacct

SEQ ID NO: 68011 - DNA, 20 bp, Artificial Sequence
  sgRNA
  NTC_3264
ctcgtgcgtctcgcacgaag

SEQ ID NO: 68012 - DNA, 20 bp, Artificial Sequence
  sgRNA
  NTC_3265
ggattcttagcgtgccgcaa

SEQ ID NO: 68013 - DNA, 20 bp, Artificial Sequence
  sgRNA
  NTC_3266
tcggcggcgatgttcaccta

SEQ ID NO: 68014 - DNA, 20 bp, Artificial Sequence
  sgRNA
  NTC_3267
cgtcactggggcgccgtact

SEQ ID NO: 68015 - DNA, 20 bp, Artificial Sequence
  sgRNA
  NTC_3268
ttctttaggacgagcgccgt

SEQ ID NO: 68016 - DNA, 20 bp, Artificial Sequence
  sgRNA
  NTC_3269
cggacgtcttcgatgtccgc

SEQ ID NO: 68017 - DNA, 20 bp, Artificial Sequence
  sgRNA
  NTC_3270
ctcgcgtcgaggaatcgtgc

SEQ ID NO: 68018 - DNA, 20 bp, Artificial Sequence
  sgRNA
  NTC_3271
acgtatgcggtacgcgctat

SEQ ID NO: 68019 - DNA, 20 bp, Artificial Sequence
  sgRNA
  NTC_3272
ggcgacggttcgacgctatt

SEQ ID NO: 68020 - DNA, 20 bp, Artificial Sequence
  sgRNA
  NTC_3273
tgtcgggatcacgcttaagc

SEQ ID NO: 68021 - DNA, 20 bp, Artificial Sequence
  sgRNA
  NTC_3274
ggtacgaggtaaatcgagaa

SEQ ID NO: 68022 - DNA, 20 bp, Artificial Sequence
  sgRNA
  NTC_3275
cagttgcgttcgctcgaaac

SEQ ID NO: 68023 - DNA, 20 bp, Artificial Sequence
  sgRNA
  NTC_3276
caagcacaatacgacgcgat

SEQ ID NO: 68024 - DNA, 20 bp, Artificial Sequence
  sgRNA
  NTC_3277
gggttcggggcgacgccatc

SEQ ID NO: 68025 - DNA, 20 bp, Artificial Sequence
  sgRNA
  NTC_3278
ttcgggagtacgtagaacgt

SEQ ID NO: 68026 - DNA, 20 bp, Artificial Sequence
  sgRNA
  NTC_3279
gtttcgtcgcgccaagtaag

SEQ ID NO: 68027 - DNA, 20 bp, Artificial Sequence
  sgRNA
  NTC_3280
cacggtattctaagcgcgcg

SEQ ID NO: 68028 - DNA, 20 bp, Artificial Sequence
  sgRNA
  NTC_3281
tgctataagcttcgtacgat

SEQ ID NO: 68029 - DNA, 20 bp, Artificial Sequence
  sgRNA
  NTC_3282
cttacgggggtccgcgcatt

SEQ ID NO: 68030 - DNA, 20 bp, Artificial Sequence
  sgRNA
  NTC_3283
atttagtttaatcccgcgcg

SEQ ID NO: 68031 - DNA, 20 bp, Artificial Sequence
  sgRNA
  NTC_3284
aacgcacggacgtcgctctg

SEQ ID NO: 68032 - DNA, 20 bp, Artificial Sequence
  sgRNA
  NTC_3285
atcgacgcggtcacgcgacg

SEQ ID NO: 68033 - DNA, 20 bp, Artificial Sequence
  sgRNA
  NTC_3286
gggttcgcattagtatcgcc

SEQ ID NO: 68034 - DNA, 20 bp, Artificial Sequence
  sgRNA
  NTC_3287
cacgaatcgagcaagccgta

SEQ ID NO: 68035 - DNA, 20 bp, Artificial Sequence
  sgRNA
  NTC_3288
cgataacttggccgcgttca

SEQ ID NO: 68036 - DNA, 20 bp, Artificial Sequence
  sgRNA
  NTC_3289
cgtcagcgtcgaatcgctta

SEQ ID NO: 68037 - DNA, 20 bp, Artificial Sequence
  sgRNA
  NTC_3290
ggcgttagagcgcctatcgc

SEQ ID NO: 68038 - DNA, 20 bp, Artificial Sequence
  sgRNA
  NTC_3291
cggcggacgtgcgcgacctt

SEQ ID NO: 68039 - DNA, 20 bp, Artificial Sequence
  sgRNA
  NTC_3292
caatactaagcgtcccgcgc

SEQ ID NO: 68040 - DNA, 20 bp, Artificial Sequence
  sgRNA
  NTC_3293
cgggtaagtactacgcatcg

SEQ ID NO: 68041 - DNA, 20 bp, Artificial Sequence
  sgRNA
  NTC_3294
cacgtgttgcgctttcgatc

SEQ ID NO: 68042 - DNA, 20 bp, Artificial Sequence
  sgRNA
  NTC_3295
tatcgggaacacgtccgtcc

SEQ ID NO: 68043 - DNA, 20 bp, Artificial Sequence
  sgRNA
  NTC_3296
gcgatatcggtccataccgc

SEQ ID NO: 68044 - DNA, 20 bp, Artificial Sequence
  sgRNA
  NTC_3297
ggcggatgcgcgagttgtgc

SEQ ID NO: 68045 - DNA, 20 bp, Artificial Sequence
  sgRNA
  NTC_3298
gattgactaacgccgcaccg

SEQ ID NO: 68046 - DNA, 20 bp, Artificial Sequence
  sgRNA
  NTC_3299
ggagttacgttgaccatacg

SEQ ID NO: 68047 - DNA, 20 bp, Artificial Sequence
  sgRNA
  NTC_3300
aagagcgttaagcgcgaaca

SEQ ID NO: 68048 - DNA, 20 bp, Artificial Sequence
  sgRNA
  NTC_3301
tgcacgctaggctcgaatca

SEQ ID NO: 68049 - DNA, 20 bp, Artificial Sequence
  sgRNA
  NTC_3302
gtttcgattaactagcgtcg

SEQ ID NO: 68050 - DNA, 20 bp, Artificial Sequence
  sgRNA
  NTC_3303
ttacggggtcgccgtctgtt

SEQ ID NO: 68051 - DNA, 20 bp, Artificial Sequence
  sgRNA
  NTC_3304
gtgaaataacagtccgccgc

SEQ ID NO: 68052 - DNA, 20 bp, Artificial Sequence
  sgRNA
  NTC_3305
ggcttatgatcactcgcgcc

SEQ ID NO: 68053 - DNA, 20 bp, Artificial Sequence
  sgRNA
  NTC_3306
ttcgcttcggacgatcgcgc

SEQ ID NO: 68054 - DNA, 20 bp, Artificial Sequence
  sgRNA
  NTC_3307
ggtgcgtcgataacgccttg

SEQ ID NO: 68055 - DNA, 20 bp, Artificial Sequence
  sgRNA
  NTC_3308
aactatcggatccgtattcg

SEQ ID NO: 68056 - DNA, 20 bp, Artificial Sequence
  sgRNA
  NTC_3309
agaacgtacgtcgttaatcc

SEQ ID NO: 68057 - DNA, 20 bp, Artificial Sequence
  sgRNA
  NTC_3310
acgaatgagcggtgcgcatt

SEQ ID NO: 68058 - DNA, 20 bp, Artificial Sequence
  sgRNA
  NTC_3311
ggggatgtgatcgccaattt

SEQ ID NO: 68059 - DNA, 20 bp, Artificial Sequence
  sgRNA
  NTC_3312
gcactttatcgaaccgcctt

SEQ ID NO: 68060 - DNA, 20 bp, Artificial Sequence
  sgRNA
  NTC_3313
cggcggtaagaatgtacgct

SEQ ID NO: 68061 - DNA, 20 bp, Artificial Sequence
  sgRNA
  NTC_3314
agcgtggtgtcatcgccgta

SEQ ID NO: 68062 - DNA, 20 bp, Artificial Sequence
  sgRNA
  NTC_3315
tgttgtgtatcgcgcgttat

SEQ ID NO: 68063 - DNA, 20 bp, Artificial Sequence
  sgRNA
  NTC_3316
gcggctacgcagcacgtgcg

SEQ ID NO: 68064 - DNA, 20 bp, Artificial Sequence
  sgRNA
  NTC_3317
agtcgtggcgtacgcgttaa

SEQ ID NO: 68065 - DNA, 20 bp, Artificial Sequence
  sgRNA
  NTC_3318
gcacgagtattccgcgactt

SEQ ID NO: 68066 - DNA, 20 bp, Artificial Sequence
  sgRNA
  NTC_3319
gtcgtcgggttgccgcttag

SEQ ID NO: 68067 - DNA, 20 bp, Artificial Sequence
  sgRNA
  NTC_3320
gctgcgttgcactccgcttg

SEQ ID NO: 68068 - DNA, 20 bp, Artificial Sequence
  sgRNA
  NTC_3321
gcgtcgagctttcgagcaat

SEQ ID NO: 68069 - DNA, 20 bp, Artificial Sequence
  sgRNA
  NTC_3322
gggcgggcagacaacgcgaa

SEQ ID NO: 68070 - DNA, 20 bp, Artificial Sequence
  sgRNA
  NTC_3323
gtctactcgaacgctcgcca

SEQ ID NO: 68071 - DNA, 20 bp, Artificial Sequence
  sgRNA
  NTC_3324
aagtacatggctgccgatac

SEQ ID NO: 68072 - DNA, 20 bp, Artificial Sequence
  sgRNA
  NTC_3325
attatggagacgcactcgaa

SEQ ID NO: 68073 - DNA, 20 bp, Artificial Sequence
  sgRNA
  NTC_3326
gtttagacgtgcccatacgc

SEQ ID NO: 68074 - DNA, 20 bp, Artificial Sequence
  sgRNA
  NTC_3327
agcgcttaatgatcgcgtag

SEQ ID NO: 68075 - DNA, 20 bp, Artificial Sequence
  sgRNA
  NTC_3328
ggatgatctaaccgcctatt

SEQ ID NO: 68076 - DNA, 20 bp, Artificial Sequence
  sgRNA
  NTC_3329
gctcgactcacgtgtacgag

SEQ ID NO: 68077 - DNA, 20 bp, Artificial Sequence
  sgRNA
  NTC_3330
gcagtttgcgcgacctactc

SEQ ID NO: 68078 - DNA, 20 bp, Artificial Sequence
  sgRNA
  NTC_3331
acgtcgcacgacctgcgtga

SEQ ID NO: 68079 - DNA, 20 bp, Artificial Sequence
  sgRNA
  NTC_3332
cgcgactgatcgattgatct

SEQ ID NO: 68080 - DNA, 20 bp, Artificial Sequence
  sgRNA
  NTC_3333
cgtctaagtctgcaccacga

SEQ ID NO: 68081 - DNA, 20 bp, Artificial Sequence
  sgRNA
  NTC_3334
cgtcgatctttcgtcgtccc

SEQ ID NO: 68082 - DNA, 20 bp, Artificial Sequence
  sgRNA
  NTC_3335
ggcgagtttcgtactaccgc

SEQ ID NO: 68083 - DNA, 20 bp, Artificial Sequence
  sgRNA
  NTC_3336
atctaatcgcgaccgccgtc

SEQ ID NO: 68084 - DNA, 20 bp, Artificial Sequence
  sgRNA
  NTC_3337
tgtagtactgcgcgacgtat

SEQ ID NO: 68085 - DNA, 20 bp, Artificial Sequence
  sgRNA
  NTC_3338
cgctcgcacgcgactcgtac

SEQ ID NO: 68086 - DNA, 20 bp, Artificial Sequence
  sgRNA
  NTC_3339
ctgagattacgccgtttcgc

SEQ ID NO: 68087 - DNA, 20 bp, Artificial Sequence
  sgRNA
  NTC_3340
tatttcgcacgcgctgaacg

SEQ ID NO: 68088 - DNA, 20 bp, Artificial Sequence
  sgRNA
  NTC_3341
gacgcgtcgagagtatgatc

SEQ ID NO: 68089 - DNA, 20 bp, Artificial Sequence
  sgRNA
  NTC_3342
cggataacgtctaactcacg

SEQ ID NO: 68090 - DNA, 20 bp, Artificial Sequence
  sgRNA
  NTC_3343
cgaaagtcgacaccgtaata

SEQ ID NO: 68091 - DNA, 20 bp, Artificial Sequence
  sgRNA
  NTC_3344
atggacgcgagtcccgacgt

SEQ ID NO: 68092 - DNA, 20 bp, Artificial Sequence
  sgRNA
  NTC_3345
actaggtcgatgtgctgagt

SEQ ID NO: 68093 - DNA, 20 bp, Artificial Sequence
  sgRNA
  NTC_3346
ttatattacgtaaccgcgcc

SEQ ID NO: 68094 - DNA, 20 bp, Artificial Sequence
  sgRNA
  NTC_3347
tcactaggggggcgcgtaac

SEQ ID NO: 68095 - DNA, 20 bp, Artificial Sequence
  sgRNA
  NTC_3348
cgttaatctcatttcgcccg

SEQ ID NO: 68096 - DNA, 20 bp, Artificial Sequence
  sgRNA
  NTC_3349
atgagtcggtggcgctcgat

SEQ ID NO: 68097 - DNA, 20 bp, Artificial Sequence
  sgRNA
  NTC_3350
taagaaggtgcgacacgccg

SEQ ID NO: 68098 - DNA, 20 bp, Artificial Sequence
  sgRNA
  NTC_3351
aaggtcatctcgcccaactt

SEQ ID NO: 68099 - DNA, 20 bp, Artificial Sequence
  sgRNA
  NTC_3352
aggttaatctcgtcgcagat

SEQ ID NO: 68100 - DNA, 20 bp, Artificial Sequence
  sgRNA
  NTC_3353
tcgtactagcagtcgtgcca

SEQ ID NO: 68101 - DNA, 20 bp, Artificial Sequence
  sgRNA
  NTC_3354
cgtcgaacgttcaatcgaat

SEQ ID NO: 68102 - DNA, 20 bp, Artificial Sequence
  sgRNA
  NTC_3355
gacttgcaaggcgtacctaa

SEQ ID NO: 68103 - DNA, 20 bp, Artificial Sequence
  sgRNA
  NTC_3356
gacgttggcatactcgccta

SEQ ID NO: 68104 - DNA, 20 bp, Artificial Sequence
  sgRNA
  NTC_3357
atgcgcttacgcagtaccgt

SEQ ID NO: 68105 - DNA, 20 bp, Artificial Sequence
  sgRNA
  NTC_3358
cgacgggggcggttcgcaac

SEQ ID NO: 68106 - DNA, 20 bp, Artificial Sequence
  sgRNA
  NTC_3359
agcgtatctcggcagcgatc

SEQ ID NO: 68107 - DNA, 20 bp, Artificial Sequence
  sgRNA
  NTC_3360
gtattacggctccgagtcgc

SEQ ID NO: 68108 - DNA, 20 bp, Artificial Sequence
  sgRNA
  NTC_3361
acggtttacgtgtttcgatc

SEQ ID NO: 68109 - DNA, 20 bp, Artificial Sequence
  sgRNA
  NTC_3362
taataggggtctcgataacg

SEQ ID NO: 68110 - DNA, 20 bp, Artificial Sequence
  sgRNA
  NTC_3363
tttcgttgacgttcgactag

SEQ ID NO: 68111 - DNA, 20 bp, Artificial Sequence
  sgRNA
  NTC_3364
ttgtcgagctcaaacccgtc

SEQ ID NO: 68112 - DNA, 20 bp, Artificial Sequence
  sgRNA
  NTC_3365
atcgaatggtcgccccgaac

SEQ ID NO: 68113 - DNA, 20 bp, Artificial Sequence
  sgRNA
  NTC_3366
ctctataggtcgcgctcgag

SEQ ID NO: 68114 - DNA, 20 bp, Artificial Sequence
  sgRNA
  NTC_3367
agtttcgagacaccgcgact

SEQ ID NO: 68115 - DNA, 20 bp, Artificial Sequence
  sgRNA
  NTC_3368
tacggatgcgttcgcgaact

SEQ ID NO: 68116 - DNA, 20 bp, Artificial Sequence
  sgRNA
  NTC_3369
tgctgcaatggacgccgtac

SEQ ID NO: 68117 - DNA, 20 bp, Artificial Sequence
  sgRNA
  NTC_3370
gagcgcaattacttcgcctg

SEQ ID NO: 68118 - DNA, 20 bp, Artificial Sequence
  sgRNA
  NTC_3371
tcgttcgaggcgcccaaacg

SEQ ID NO: 68119 - DNA, 20 bp, Artificial Sequence
  sgRNA
  NTC_3372
gctcgcgatatcgacccatt

SEQ ID NO: 68120 - DNA, 20 bp, Artificial Sequence
  sgRNA
  NTC_3373
ttataacacggtcgcgagca

SEQ ID NO: 68121 - DNA, 20 bp, Artificial Sequence
  sgRNA
  NTC_3374
actgcgcgggttcgttatat

SEQ ID NO: 68122 - DNA, 20 bp, Artificial Sequence
  sgRNA
  NTC_3375
gcaacatagatcgacgaacc

SEQ ID NO: 68123 - DNA, 20 bp, Artificial Sequence
  sgRNA
  NTC_3376
gattggaagacacgtcgcac

SEQ ID NO: 68124 - DNA, 20 bp, Artificial Sequence
  sgRNA
  NTC_3377
ttggttgactcgcgagccga

SEQ ID NO: 68125 - DNA, 20 bp, Artificial Sequence
  sgRNA
  NTC_3378
attagacgctgacgacgcaa

SEQ ID NO: 68126 - DNA, 20 bp, Artificial Sequence
  sgRNA
  NTC_3379
ataatggcggtttcgcccag

SEQ ID NO: 68127 - DNA, 20 bp, Artificial Sequence
  sgRNA
  NTC_3380
agtcggcgcatcccgtcagt

SEQ ID NO: 68128 - DNA, 20 bp, Artificial Sequence
  sgRNA
  NTC_3381
gacggcaagcgctcccataa

SEQ ID NO: 68129 - DNA, 20 bp, Artificial Sequence
  sgRNA
  NTC_3382
cgtgcaactcttaaccgccc

SEQ ID NO: 68130 - DNA, 20 bp, Artificial Sequence
  sgRNA
  NTC_3383
gcacggtagaacccgctgca

SEQ ID NO: 68131 - DNA, 20 bp, Artificial Sequence
  sgRNA
  NTC_3384
aaactcgaatgctacgtaac

SEQ ID NO: 68132 - DNA, 20 bp, Artificial Sequence
  sgRNA
  NTC_3385
cgattgtaagacgccgatta

SEQ ID NO: 68133 - DNA, 20 bp, Artificial Sequence
  sgRNA
  NTC_3386
cggatttcacgcgctagcta

SEQ ID NO: 68134 - DNA, 20 bp, Artificial Sequence
  sgRNA
  NTC_3387
ttcggttggtcgagacgcct

SEQ ID NO: 68135 - DNA, 20 bp, Artificial Sequence
  sgRNA
  NTC_3388
aataaatgcgggccgtatcg

SEQ ID NO: 68136 - DNA, 20 bp, Artificial Sequence
  sgRNA
  NTC_3389
gacacatacgctgccgataa

SEQ ID NO: 68137 - DNA, 20 bp, Artificial Sequence
  sgRNA
  NTC_3390
agtaggttcatcgacccgac

SEQ ID NO: 68138 - DNA, 20 bp, Artificial Sequence
  sgRNA
  NTC_3391
ggtacatgtcaccccgcgac

SEQ ID NO: 68139 - DNA, 20 bp, Artificial Sequence
  sgRNA
  NTC_3392
ctacagcgtacgcgcgtcag

SEQ ID NO: 68140 - DNA, 20 bp, Artificial Sequence
  sgRNA
  NTC_3393
tggcgctgtacacccgtcgt

SEQ ID NO: 68141 - DNA, 20 bp, Artificial Sequence
  sgRNA
  NTC_3394
aagtattcgaagcgctcgac

SEQ ID NO: 68142 - DNA, 20 bp, Artificial Sequence
  sgRNA
  NTC_3395
tgatcagttgcgcacgagtt

SEQ ID NO: 68143 - DNA, 20 bp, Artificial Sequence
  sgRNA
  NTC_3396
ctcggtgggggcgacaacga

SEQ ID NO: 68144 - DNA, 20 bp, Artificial Sequence
  sgRNA
  NTC_3397
gacgcgtcgatagttcgcaa

SEQ ID NO: 68145 - DNA, 20 bp, Artificial Sequence
  sgRNA
  NTC_3398
gacttcaacttcgccgtcct

SEQ ID NO: 68146 - DNA, 20 bp, Artificial Sequence
  sgRNA
  NTC_3399
cggcgatatacgtccactta

SEQ ID NO: 68147 - DNA, 20 bp, Artificial Sequence
  sgRNA
  NTC_3400
acttaatatatcaccgttcg

SEQ ID NO: 68148 - DNA, 20 bp, Artificial Sequence
  sgRNA
  NTC_3401
acaggctactatgacgaatc

SEQ ID NO: 68149 - DNA, 20 bp, Artificial Sequence
  sgRNA
  NTC_3402
tcgcagcgggacgctcgttc

SEQ ID NO: 68150 - DNA, 20 bp, Artificial Sequence
  sgRNA
  NTC_3403
gcacggacgcgtaaacgtcc

SEQ ID NO: 68151 - DNA, 20 bp, Artificial Sequence
  sgRNA
  NTC_3404
atcacgaagttatttcgcgc

SEQ ID NO: 68152 - DNA, 20 bp, Artificial Sequence
  sgRNA
  NTC_3405
gtacatcgatagaccgtgct

SEQ ID NO: 68153 - DNA, 20 bp, Artificial Sequence
  sgRNA
  NTC_3406
aaatacgggatactcgagtt

SEQ ID NO: 68154 - DNA, 20 bp, Artificial Sequence
  sgRNA
  NTC_3407
actcttacggacgccgaagt

SEQ ID NO: 68155 - DNA, 20 bp, Artificial Sequence
  sgRNA
  NTC_3408
acgtgtgactataccgattt

SEQ ID NO: 68156 - DNA, 20 bp, Artificial Sequence
  sgRNA
  NTC_3409
cataagtgatcgcgatgcga

SEQ ID NO: 68157 - DNA, 20 bp, Artificial Sequence
  sgRNA
  NTC_3410
actctgtcgaacgtcgtaag

SEQ ID NO: 68158 - DNA, 20 bp, Artificial Sequence
  sgRNA
  NTC_3411
cgtcgctcttctcgccgaaa

SEQ ID NO: 68159 - DNA, 20 bp, Artificial Sequence
  sgRNA
  NTC_3412
gtcgactctaacgtcgaacg

SEQ ID NO: 68160 - DNA, 20 bp, Artificial Sequence
  sgRNA
  NTC_3413
ggactgcgttaaacgttgcg

SEQ ID NO: 68161 - DNA, 20 bp, Artificial Sequence
  sgRNA
  NTC_3414
aaaatatcgcgtacgtcgac

SEQ ID NO: 68162 - DNA, 20 bp, Artificial Sequence
  sgRNA
  NTC_3415
acagtcgacttcgcactgcg

SEQ ID NO: 68163 - DNA, 20 bp, Artificial Sequence
  sgRNA
  NTC_3416
gttgctctacgcgactccga

SEQ ID NO: 68164 - DNA, 20 bp, Artificial Sequence
  sgRNA
  NTC_3417
tgagcactaatccacgcaat

SEQ ID NO: 68165 - DNA, 20 bp, Artificial Sequence
  sgRNA
  NTC_3418
gtggttactacgttagccga

SEQ ID NO: 68166 - DNA, 20 bp, Artificial Sequence
  sgRNA
  NTC_3419
cgattcttcgaccgtaattg

SEQ ID NO: 68167 - DNA, 20 bp, Artificial Sequence
  sgRNA
  NTC_3420
cggggcgcttaccatagtcc

SEQ ID NO: 68168 - DNA, 20 bp, Artificial Sequence
  sgRNA
  NTC_3421
tttgtagcacgccgtagtag

SEQ ID NO: 68169 - DNA, 20 bp, Artificial Sequence
  sgRNA
  NTC_3422
cgctggctggatcgcaacgt

SEQ ID NO: 68170 - DNA, 20 bp, Artificial Sequence
  sgRNA
  NTC_3423
tcgtaacgcgacgcgaccct

SEQ ID NO: 68171 - DNA, 20 bp, Artificial Sequence
  sgRNA
  NTC_3424
gaacgtgcggtacccgtccg

SEQ ID NO: 68172 - DNA, 20 bp, Artificial Sequence
  sgRNA
  NTC_3425
gatcgagcgttctagcgctg

SEQ ID NO: 68173 - DNA, 20 bp, Artificial Sequence
  sgRNA
  NTC_3426
cgggttcgtcgattagtcag

SEQ ID NO: 68174 - DNA, 20 bp, Artificial Sequence
  sgRNA
  NTC_3427
cacatcgcgaagccgaaatt

SEQ ID NO: 68175 - DNA, 20 bp, Artificial Sequence
  sgRNA
  NTC_3428
gcttcgagttgacgcgcgcc

SEQ ID NO: 68176 - DNA, 20 bp, Artificial Sequence
  sgRNA
  NTC_3429
gtctgtcgctcattatcgtc

SEQ ID NO: 68177 - DNA, 20 bp, Artificial Sequence
  sgRNA
  NTC_3430
cgtacacgtacgccacataa

SEQ ID NO: 68178 - DNA, 20 bp, Artificial Sequence
  sgRNA
  NTC_3431
cgaaacgggcttacgccgta

SEQ ID NO: 68179 - DNA, 20 bp, Artificial Sequence
  sgRNA
  NTC_3432
tagcgaaacgcgttcaaccg

SEQ ID NO: 68180 - DNA, 20 bp, Artificial Sequence
  sgRNA
  NTC_3433
acgtctcgtgagttaagcgt

SEQ ID NO: 68181 - DNA, 20 bp, Artificial Sequence
  sgRNA
  NTC_3434
tttcgtcgcgcgtcgcgaga

SEQ ID NO: 68182 - DNA, 20 bp, Artificial Sequence
  sgRNA
  NTC_3435
ctcactgcggttgcgtccgc

SEQ ID NO: 68183 - DNA, 20 bp, Artificial Sequence
  sgRNA
  NTC_3436
tacgtagttgacgtccaacg

SEQ ID NO: 68184 - DNA, 20 bp, Artificial Sequence
  sgRNA
  NTC_3437
tacgagtcgcttgccgtacc

SEQ ID NO: 68185 - DNA, 20 bp, Artificial Sequence
  sgRNA
  NTC_3438
ttcactatcagattcgttcg

SEQ ID NO: 68186 - DNA, 20 bp, Artificial Sequence
  sgRNA
  NTC_3439
tataacgtatcgcgatcgct

SEQ ID NO: 68187 - DNA, 20 bp, Artificial Sequence
  sgRNA
  NTC_3440
gcatgtgtcgctacgcgacg

SEQ ID NO: 68188 - DNA, 20 bp, Artificial Sequence
  sgRNA
  NTC_3441
taacgtagtagttccgacgt

SEQ ID NO: 68189 - DNA, 20 bp, Artificial Sequence
  sgRNA
  NTC_3442
gttaagctcatgttcgcgag

SEQ ID NO: 68190 - DNA, 20 bp, Artificial Sequence
  sgRNA
  NTC_3443
cggtggctcggtaaaaattt

SEQ ID NO: 68191 - DNA, 20 bp, Artificial Sequence
  sgRNA
  NTC_3444
taggcgcatacgcctactag

SEQ ID NO: 68192 - DNA, 20 bp, Artificial Sequence
  sgRNA
  NTC_3445
tcgggtcgtgcgcgtcccgt

SEQ ID NO: 68193 - DNA, 20 bp, Artificial Sequence
  sgRNA
  NTC_3446
atgcggatgcgcaagtatta

SEQ ID NO: 68194 - DNA, 20 bp, Artificial Sequence
  sgRNA
  NTC_3447
ggcagtatacgtccgcgcgt

SEQ ID NO: 68195 - DNA, 20 bp, Artificial Sequence
  sgRNA
  NTC_3448
tcgtgaggcacgagattgac

SEQ ID NO: 68196 - DNA, 20 bp, Artificial Sequence
  sgRNA
  NTC_3449
ggggacgacgcatgatacgc

SEQ ID NO: 68197 - DNA, 20 bp, Artificial Sequence
  sgRNA
  NTC_3450
aggtctacgtagcccgcatg

SEQ ID NO: 68198 - DNA, 20 bp, Artificial Sequence
  sgRNA
  NTC_3451
tgaactggtagagtcgcgcc

SEQ ID NO: 68199 - DNA, 20 bp, Artificial Sequence
  sgRNA
  NTC_3452
gtctattatgacaacgagtt

SEQ ID NO: 68200 - DNA, 20 bp, Artificial Sequence
  sgRNA
  NTC_3453
ttggcgcgggctcgcttacg

SEQ ID NO: 68201 - DNA, 20 bp, Artificial Sequence
  sgRNA
  NTC_3454
ctacgtcgcttccgcgcgca

SEQ ID NO: 68202 - DNA, 20 bp, Artificial Sequence
  sgRNA
  NTC_3455
gcgcgactacactcgctatt

SEQ ID NO: 68203 - DNA, 20 bp, Artificial Sequence
  sgRNA
  NTC_3456
aaaggctcgttccgacgatt

SEQ ID NO: 68204 - DNA, 20 bp, Artificial Sequence
  sgRNA
  NTC_3457
gctcgcgtattaagccgcct

SEQ ID NO: 68205 - DNA, 20 bp, Artificial Sequence
  sgRNA
  NTC_3458
gctcgaatactccgcagtgc

SEQ ID NO: 68206 - DNA, 20 bp, Artificial Sequence
  sgRNA
  NTC_3459
cgatcacaacacgccgccaa

SEQ ID NO: 68207 - DNA, 20 bp, Artificial Sequence
  sgRNA
  NTC_3460
gtcgcgagcgaactccccct

SEQ ID NO: 68208 - DNA, 20 bp, Artificial Sequence
  sgRNA
  NTC_3461
tcggcgcgaatacaatgtcg

SEQ ID NO: 68209 - DNA, 20 bp, Artificial Sequence
  sgRNA
  NTC_3462
ctcgaagcacggcgcgacca

SEQ ID NO: 68210 - DNA, 20 bp, Artificial Sequence
  sgRNA
  NTC_3463
tgcgcatttaggccgtaacg

SEQ ID NO: 68211 - DNA, 20 bp, Artificial Sequence
  sgRNA
  NTC_3464
cgcgtaatggcatgtcgatc

SEQ ID NO: 68212 - DNA, 20 bp, Artificial Sequence
  sgRNA
  NTC_3465
gtacacgcgatcgtaaatcg

SEQ ID NO: 68213 - DNA, 20 bp, Artificial Sequence
  sgRNA
  NTC_3466
acgcagttgtacgtccgtgc

SEQ ID NO: 68214 - DNA, 20 bp, Artificial Sequence
  sgRNA
  NTC_3467
gatcgctggggctattaccg

SEQ ID NO: 68215 - DNA, 20 bp, Artificial Sequence
  sgRNA
  NTC_3468
gacgtgctcaacgtacgtta

SEQ ID NO: 68216 - DNA, 20 bp, Artificial Sequence
  sgRNA
  NTC_3469
agcgtcgtgcttattaacta

SEQ ID NO: 68217 - DNA, 20 bp, Artificial Sequence
  sgRNA
  NTC_3470
gacgggtttcaagacgagcg

SEQ ID NO: 68218 - DNA, 20 bp, Artificial Sequence
  sgRNA
  NTC_3471
gtgtggcataacgtcgtccg

SEQ ID NO: 68219 - DNA, 20 bp, Artificial Sequence
  sgRNA
  NTC_3472
gaatcggcggtgcgcctttc

SEQ ID NO: 68220 - DNA, 20 bp, Artificial Sequence
  sgRNA
  NTC_3473
gtaatagttcgctccgtaag

SEQ ID NO: 68221 - DNA, 20 bp, Artificial Sequence
  sgRNA
  NTC_3474
tgcggggacgctataccgat

SEQ ID NO: 68222 - DNA, 20 bp, Artificial Sequence
  sgRNA
  NTC_3475
aacggataagttcgtgatcg

SEQ ID NO: 68223 - DNA, 20 bp, Artificial Sequence
  sgRNA
  NTC_3476
aattcggcgtatttccgacg

SEQ ID NO: 68224 - DNA, 20 bp, Artificial Sequence
  sgRNA
  NTC_3477
ctatcgcggtgcgcccgatc

SEQ ID NO: 68225 - DNA, 20 bp, Artificial Sequence
  sgRNA
  NTC_3478
ggtgctggtcgccgtccgat

SEQ ID NO: 68226 - DNA, 20 bp, Artificial Sequence
  sgRNA
  NTC_3479
tcgagatcgggccctagtaa

SEQ ID NO: 68227 - DNA, 20 bp, Artificial Sequence
  sgRNA
  NTC_3480
gtctacgcggttagcgcgat

SEQ ID NO: 68228 - DNA, 20 bp, Artificial Sequence
  sgRNA
  NTC_3481
gttgcaacgcttcacatcgt

SEQ ID NO: 68229 - DNA, 20 bp, Artificial Sequence
  sgRNA
  NTC_3482
catcgggtcaatccgaagtc

SEQ ID NO: 68230 - DNA, 20 bp, Artificial Sequence
  sgRNA
  NTC_3483
gcggggtatgcgataacgcc

SEQ ID NO: 68231 - DNA, 20 bp, Artificial Sequence
  sgRNA
  NTC_3484
aacgtagcgaacatacgatc

SEQ ID NO: 68232 - DNA, 20 bp, Artificial Sequence
  sgRNA
  NTC_3485
tttgtcgcatacccgatcgt

SEQ ID NO: 68233 - DNA, 20 bp, Artificial Sequence
  sgRNA
  NTC_3486
taacgacttgtatgtccgcg

SEQ ID NO: 68234 - DNA, 20 bp, Artificial Sequence
  sgRNA
  NTC_3487
acgtcggggataatatcgcg

SEQ ID NO: 68235 - DNA, 20 bp, Artificial Sequence
  sgRNA
  NTC_3488
ggcggttgtactaacaccga

SEQ ID NO: 68236 - DNA, 20 bp, Artificial Sequence
  sgRNA
  NTC_3489
tacgcaacgtcgttcgaacg

SEQ ID NO: 68237 - DNA, 20 bp, Artificial Sequence
  sgRNA
  NTC_3490
agcgtacgtacgtccgattt

SEQ ID NO: 68238 - DNA, 20 bp, Artificial Sequence
  sgRNA
  NTC_3491
gctgggacgagccgatacga

SEQ ID NO: 68239 - DNA, 20 bp, Artificial Sequence
  sgRNA
  NTC_3492
caggcgactgacgcaattat

SEQ ID NO: 68240 - DNA, 20 bp, Artificial Sequence
  sgRNA
  NTC_3493
aaagagtgcgatcccgtata

SEQ ID NO: 68241 - DNA, 20 bp, Artificial Sequence
  sgRNA
  NTC_3494
aacgcgttgcgacgtgcact

SEQ ID NO: 68242 - DNA, 20 bp, Artificial Sequence
  sgRNA
  NTC_3495
tcgttaagtttcgttacgag

SEQ ID NO: 68243 - DNA, 20 bp, Artificial Sequence
  sgRNA
  NTC_3496
ggcgtggtcgtccgagatta

SEQ ID NO: 68244 - DNA, 20 bp, Artificial Sequence
  sgRNA
  NTC_3497
gctaattgtagccgatgcac

SEQ ID NO: 68245 - DNA, 20 bp, Artificial Sequence
  sgRNA
  NTC_3498
cggggcatttacgcgttcga

SEQ ID NO: 68246 - DNA, 20 bp, Artificial Sequence
  sgRNA
  NTC_3499
ttcacacgttatcacgcgcc

SEQ ID NO: 68247 - DNA, 20 bp, Artificial Sequence
  sgRNA
  NTC_3500
atcgtctatggatcacgccg

SEQ ID NO: 68248 - DNA, 20 bp, Artificial Sequence
  sgRNA
  NTC_3501
acgctatgaataagcgcgta

SEQ ID NO: 68249 - DNA, 20 bp, Artificial Sequence
  sgRNA
  NTC_3502
tgtacgatgtcttccgtagc

SEQ ID NO: 68250 - DNA, 20 bp, Artificial Sequence
  sgRNA
  NTC_3503
cttgggagaatcttcgatcc

SEQ ID NO: 68251 - DNA, 20 bp, Artificial Sequence
  sgRNA
  NTC_3504
acgctggtttcgcctctatc

SEQ ID NO: 68252 - DNA, 20 bp, Artificial Sequence
  sgRNA
  NTC_3505
cattcgcgtctcgtcgtata

SEQ ID NO: 68253 - DNA, 20 bp, Artificial Sequence
  sgRNA
  NTC_3506
aacgggatttcgtataagcg

SEQ ID NO: 68254 - DNA, 20 bp, Artificial Sequence
  sgRNA
  NTC_3507
ggcgggcgtcggacgcataa

SEQ ID NO: 68255 - DNA, 20 bp, Artificial Sequence
  sgRNA
  NTC_3508
tacggttgtcgtcgcgaccg

SEQ ID NO: 68256 - DNA, 20 bp, Artificial Sequence
  sgRNA
  NTC_3509
tgcgcgtcgtatccgtgcta

SEQ ID NO: 68257 - DNA, 20 bp, Artificial Sequence
  sgRNA
  NTC_3510
gtgcggcgaacgctaattct

SEQ ID NO: 68258 - DNA, 20 bp, Artificial Sequence
  sgRNA
  NTC_3511
acatcgacgtacgtcccatc

SEQ ID NO: 68259 - DNA, 20 bp, Artificial Sequence
  sgRNA
  NTC_3512
ggcgattctcgtatataacc

SEQ ID NO: 68260 - DNA, 20 bp, Artificial Sequence
  sgRNA
  NTC_3513
ttgcacgttaagcgtcgtct

SEQ ID NO: 68261 - DNA, 20 bp, Artificial Sequence
  sgRNA
  NTC_3514
ggcggttaggttgcgccgaa

SEQ ID NO: 68262 - DNA, 20 bp, Artificial Sequence
  sgRNA
  NTC_3515
tctattattctactacgatc

SEQ ID NO: 68263 - DNA, 20 bp, Artificial Sequence
  sgRNA
  NTC_3516
acaaatgggtcgaccactac

SEQ ID NO: 68264 - DNA, 20 bp, Artificial Sequence
  sgRNA
  NTC_3517
ttcgtacgcgcaacccaacg

SEQ ID NO: 68265 - DNA, 20 bp, Artificial Sequence
  sgRNA
  NTC_3518
taaactggcattacacgcgt

SEQ ID NO: 68266 - DNA, 20 bp, Artificial Sequence
  sgRNA
  NTC_3519
ggggctaactcaatatgtcg

SEQ ID NO: 68267 - DNA, 20 bp, Artificial Sequence
  sgRNA
  NTC_3520
acgtggctgacgcacgaaca

SEQ ID NO: 68268 - DNA, 20 bp, Artificial Sequence
  sgRNA
  NTC_3521
gcaggattactatcgcgtag

SEQ ID NO: 68269 - DNA, 20 bp, Artificial Sequence
  sgRNA
  NTC_3522
gtcgcacgctcaacttgatt

SEQ ID NO: 68270 - DNA, 20 bp, Artificial Sequence
  sgRNA
  NTC_3523
gactatcgcacgcgcacgtc

SEQ ID NO: 68271 - DNA, 20 bp, Artificial Sequence
  sgRNA
  NTC_3524
gtcgcggggcgagtcgagtg

SEQ ID NO: 68272 - DNA, 20 bp, Artificial Sequence
  sgRNA
  NTC_3525
cgaatctaacgcgacgctac

SEQ ID NO: 68273 - DNA, 20 bp, Artificial Sequence
  sgRNA
  NTC_3526
catcgcattgcgcgcaagag

SEQ ID NO: 68274 - DNA, 20 bp, Artificial Sequence
  sgRNA
  NTC_3527
cattgtgcgatccacgagaa

SEQ ID NO: 68275 - DNA, 20 bp, Artificial Sequence
  sgRNA
  NTC_3528
aaggcgtaacgtcgtagccg

SEQ ID NO: 68276 - DNA, 20 bp, Artificial Sequence
  sgRNA
  NTC_3529
tttactacactttgcgttat

SEQ ID NO: 68277 - DNA, 20 bp, Artificial Sequence
  sgRNA
  NTC_3530
tcacgggacgtacgatacgt

SEQ ID NO: 68278 - DNA, 20 bp, Artificial Sequence
  sgRNA
  NTC_3531
aattgcgcgataaccgtaac

SEQ ID NO: 68279 - DNA, 20 bp, Artificial Sequence
  sgRNA
  NTC_3532
gatggggtacgatgcgactt

SEQ ID NO: 68280 - DNA, 20 bp, Artificial Sequence
  sgRNA
  NTC_3533
atcacttcaacgcgctccat

SEQ ID NO: 68281 - DNA, 20 bp, Artificial Sequence
  sgRNA
  NTC_3534
gtgcgcgacgagtccgaacg

SEQ ID NO: 68282 - DNA, 20 bp, Artificial Sequence
  sgRNA
  NTC_3535
ggggctagtacgtcaacgcg

SEQ ID NO: 68283 - DNA, 20 bp, Artificial Sequence
  sgRNA
  NTC_3536
gcgcatagtgatcgtcaccg

SEQ ID NO: 68284 - DNA, 20 bp, Artificial Sequence
  sgRNA
  NTC_3537
gtagatcggcgatagtctcg

SEQ ID NO: 68285 - DNA, 20 bp, Artificial Sequence
  sgRNA
  NTC_3538
gtcggcgctggcacgccgta

SEQ ID NO: 68286 - DNA, 20 bp, Artificial Sequence
  sgRNA
  NTC_3539
tcttgctaaagttacgcttc

SEQ ID NO: 68287 - DNA, 20 bp, Artificial Sequence
  sgRNA
  NTC_3540
gctcgacgcggagaacgatc

SEQ ID NO: 68288 - DNA, 20 bp, Artificial Sequence
  sgRNA
  NTC_3541
gctcgtaatcagatagtcgc

SEQ ID NO: 68289 - DNA, 20 bp, Artificial Sequence
  sgRNA
  NTC_3542
ggtaggtgtgtccgactacg

SEQ ID NO: 68290 - DNA, 20 bp, Artificial Sequence
  sgRNA
  NTC_3543
atcagctaattcgacgcgcg

SEQ ID NO: 68291 - DNA, 20 bp, Artificial Sequence
  sgRNA
  NTC_3544
tgggagtactaactcgccgt

SEQ ID NO: 68292 - DNA, 20 bp, Artificial Sequence
  sgRNA
  NTC_3545
gcgtagcagttaattccacg

SEQ ID NO: 68293 - DNA, 20 bp, Artificial Sequence
  sgRNA
  NTC_3546
tcatatctggtcgcgaccga

SEQ ID NO: 68294 - DNA, 20 bp, Artificial Sequence
  sgRNA
  NTC_3547
tggagttggacgatctcgtt

SEQ ID NO: 68295 - DNA, 20 bp, Artificial Sequence
  sgRNA
  NTC_3548
gcgattatacgaaccagtgc

SEQ ID NO: 68296 - DNA, 20 bp, Artificial Sequence
  sgRNA
  NTC_3549
ctctcgactctacaccgcgt

SEQ ID NO: 68297 - DNA, 20 bp, Artificial Sequence
  sgRNA
  NTC_3550
cgcacgtttacaatcgagcc

SEQ ID NO: 68298 - DNA, 20 bp, Artificial Sequence
  sgRNA
  NTC_3551
atcattagcttacgcgacgc

SEQ ID NO: 68299 - DNA, 20 bp, Artificial Sequence
  sgRNA
  NTC_3552
acggcggattaatcactacg

SEQ ID NO: 68300 - DNA, 20 bp, Artificial Sequence
  sgRNA
  NTC_3553
aagtcgtcaacgcgatacta

SEQ ID NO: 68301 - DNA, 20 bp, Artificial Sequence
  sgRNA
  NTC_3554
tagggacggacgaacgcttc

SEQ ID NO: 68302 - DNA, 20 bp, Artificial Sequence
  sgRNA
  NTC_3555
cgtgtcgaagctcgcgattg

SEQ ID NO: 68303 - DNA, 20 bp, Artificial Sequence
  sgRNA
  NTC_3556
tttgtagactacaacgaacc

SEQ ID NO: 68304 - DNA, 20 bp, Artificial Sequence
  sgRNA
  NTC_3557
gtcgaggctgcgcgccatta

SEQ ID NO: 68305 - DNA, 20 bp, Artificial Sequence
  sgRNA
  NTC_3558
gtatcgcgacgacgcagtcg

SEQ ID NO: 68306 - DNA, 20 bp, Artificial Sequence
  sgRNA
  NTC_3559
ctcgaaaacatgcgctatcc

SEQ ID NO: 68307 - DNA, 20 bp, Artificial Sequence
  sgRNA
  NTC_3560
acgatacgggtgtacgcgaa

SEQ ID NO: 68308 - DNA, 20 bp, Artificial Sequence
  sgRNA
  NTC_3561
tcgcgacgttatacgaaaga

SEQ ID NO: 68309 - DNA, 20 bp, Artificial Sequence
  sgRNA
  NTC_3562
acggcgttcaagcgaaaagt

SEQ ID NO: 68310 - DNA, 20 bp, Artificial Sequence
  sgRNA
  NTC_3563
tacaagtcgcggtgcgaagt

SEQ ID NO: 68311 - DNA, 20 bp, Artificial Sequence
  sgRNA
  NTC_3564
ctggcgcactcacactacgt

SEQ ID NO: 68312 - DNA, 20 bp, Artificial Sequence
  sgRNA
  NTC_3565
aatttatatcgtcgcgcgtc

SEQ ID NO: 68313 - DNA, 20 bp, Artificial Sequence
  sgRNA
  NTC_3566
tatctacgcttatcgcgaat

SEQ ID NO: 68314 - DNA, 20 bp, Artificial Sequence
  sgRNA
  NTC_3567
aactggctaagcgtccgtcg

SEQ ID NO: 68315 - DNA, 20 bp, Artificial Sequence
  sgRNA
  NTC_3568
ggacgatgactacgcgtccg

SEQ ID NO: 68316 - DNA, 20 bp, Artificial Sequence
  sgRNA
  NTC_3569
atacggacgttccgacgtgc

SEQ ID NO: 68317 - DNA, 20 bp, Artificial Sequence
  sgRNA
  NTC_3570
cggtcgcgaactagtatcta

SEQ ID NO: 68318 - DNA, 20 bp, Artificial Sequence
  sgRNA
  NTC_3571
cgctcgtgtcgccatcgata

SEQ ID NO: 68319 - DNA, 20 bp, Artificial Sequence
  sgRNA
  NTC_3572
cgctcgcatgacaactgatc

SEQ ID NO: 68320 - DNA, 20 bp, Artificial Sequence
  sgRNA
  NTC_3573
tcgatgactaaatcgccccc

SEQ ID NO: 68321 - DNA, 20 bp, Artificial Sequence
  sgRNA
  NTC_3574
gtctcgacgaggcgacgaat

SEQ ID NO: 68322 - DNA, 20 bp, Artificial Sequence
  sgRNA
  NTC_3575
aacagcacgagtcgagcgcg

SEQ ID NO: 68323 - DNA, 20 bp, Artificial Sequence
  sgRNA
  NTC_3576
ctcgggtattcgaacgtaga

SEQ ID NO: 68324 - DNA, 20 bp, Artificial Sequence
  sgRNA
  NTC_3577
cgcggggtagtcttgacacg

SEQ ID NO: 68325 - DNA, 20 bp, Artificial Sequence
  sgRNA
  NTC_3578
acgtcggttatactcgctct

SEQ ID NO: 68326 - DNA, 20 bp, Artificial Sequence
  sgRNA
  NTC_3579
aattatgctgggtacgacgc

SEQ ID NO: 68327 - DNA, 20 bp, Artificial Sequence
  sgRNA
  NTC_3580
atgcgatcgcgtcgataatt

SEQ ID NO: 68328 - DNA, 20 bp, Artificial Sequence
  sgRNA
  NTC_3581
ttcttataacgttccgatct

SEQ ID NO: 68329 - DNA, 20 bp, Artificial Sequence
  sgRNA
  NTC_3582
ctacgagcaatcgacgatgc

SEQ ID NO: 68330 - DNA, 20 bp, Artificial Sequence
  sgRNA
  NTC_3583
taggcttcgatccgtcgaac

SEQ ID NO: 68331 - DNA, 20 bp, Artificial Sequence
  sgRNA
  NTC_3584
tcggataggtacgcgtatcg

SEQ ID NO: 68332 - DNA, 20 bp, Artificial Sequence
  sgRNA
  NTC_3585
ggcggcttcgagcgcttata

SEQ ID NO: 68333 - DNA, 20 bp, Artificial Sequence
  sgRNA
  NTC_3586
aatcgttgggtcgacgtgat

SEQ ID NO: 68334 - DNA, 20 bp, Artificial Sequence
  sgRNA
  NTC_3587
caaacgaggctagctcgacg

SEQ ID NO: 68335 - DNA, 20 bp, Artificial Sequence
  sgRNA
  NTC_3588
gacgggcatgttcatacgcg

SEQ ID NO: 68336 - DNA, 20 bp, Artificial Sequence
  sgRNA
  NTC_3589
aacgagcgggactcgtctac

SEQ ID NO: 68337 - DNA, 20 bp, Artificial Sequence
  sgRNA
  NTC_3590
cacgacgggtgtcgaaagtt

SEQ ID NO: 68338 - DNA, 20 bp, Artificial Sequence
  sgRNA
  NTC_3591
acgaaagcaatccgcgacaa

SEQ ID NO: 68339 - DNA, 20 bp, Artificial Sequence
  sgRNA
  NTC_3592
ttgtcgcgatgtgcgctcct

SEQ ID NO: 68340 - DNA, 20 bp, Artificial Sequence
  sgRNA
  NTC_3593
cttgtgatagagcgcgcgtc

SEQ ID NO: 68341 - DNA, 20 bp, Artificial Sequence
  sgRNA
  NTC_3594
gagttgttacacgtcgttcc

SEQ ID NO: 68342 - DNA, 20 bp, Artificial Sequence
  sgRNA
  NTC_3595
aggatacgatacatccgccg

SEQ ID NO: 68343 - DNA, 20 bp, Artificial Sequence
  sgRNA
  NTC_3596
agtacgcggtcgcccgatgt

SEQ ID NO: 68344 - DNA, 20 bp, Artificial Sequence
  sgRNA
  NTC_3597
gggtttagcgcgcgcgttga

SEQ ID NO: 68345 - DNA, 20 bp, Artificial Sequence
  sgRNA
  NTC_3598
cggacgttacatcagctcgc

SEQ ID NO: 68346 - DNA, 20 bp, Artificial Sequence
  sgRNA
  NTC_3599
aactcgcttacgcccgtagt

SEQ ID NO: 68347 - DNA, 20 bp, Artificial Sequence
  sgRNA
  NTC_3600
cgatcgtcgctatccgtccg

SEQ ID NO: 68348 - DNA, 20 bp, Artificial Sequence
  sgRNA
  NTC_3601
ttcgacggcggtccgattag

SEQ ID NO: 68349 - DNA, 20 bp, Artificial Sequence
  sgRNA
  NTC_3602
acagcgatggtcgtcgagat

SEQ ID NO: 68350 - DNA, 20 bp, Artificial Sequence
  sgRNA
  NTC_3603
gtggaggagttaccccctat

SEQ ID NO: 68351 - DNA, 20 bp, Artificial Sequence
  sgRNA
  NTC_3604
acacgtggtcggacccgcca

SEQ ID NO: 68352 - DNA, 20 bp, Artificial Sequence
  sgRNA
  NTC_3605
gcgagacttcgaacgacttg

SEQ ID NO: 68353 - DNA, 20 bp, Artificial Sequence
  sgRNA
  NTC_3606
gtagcggcggtacgtgcgtc

SEQ ID NO: 68354 - DNA, 20 bp, Artificial Sequence
  sgRNA
  NTC_3607
cgcgacaaggactccgaccg

SEQ ID NO: 68355 - DNA, 20 bp, Artificial Sequence
  sgRNA
  NTC_3608
gacgtactattacgcaagcg

SEQ ID NO: 68356 - DNA, 20 bp, Artificial Sequence
  sgRNA
  NTC_3609
gcgcggtgatgcattaaatc

SEQ ID NO: 68357 - DNA, 20 bp, Artificial Sequence
  sgRNA
  NTC_3610
tggtcgctacgacgcaatcc

SEQ ID NO: 68358 - DNA, 20 bp, Artificial Sequence
  sgRNA
  NTC_3611
ggaactcagtcgtgcgagac

SEQ ID NO: 68359 - DNA, 20 bp, Artificial Sequence
  sgRNA
  NTC_3612
acgacggcgggcacttaccg

SEQ ID NO: 68360 - DNA, 20 bp, Artificial Sequence
  sgRNA
  NTC_3613
cgcgcgcgattaattgttgc

SEQ ID NO: 68361 - DNA, 20 bp, Artificial Sequence
  sgRNA
  NTC_3614
tagttgtagtgccgttatac

SEQ ID NO: 68362 - DNA, 20 bp, Artificial Sequence
  sgRNA
  NTC_3615
ttacgttgtgcatcgacgag

SEQ ID NO: 68363 - DNA, 20 bp, Artificial Sequence
  sgRNA
  NTC_3616
tgcgtgctagaacgccagtc

SEQ ID NO: 68364 - DNA, 20 bp, Artificial Sequence
  sgRNA
  NTC_3617
tcgcgcgaataccaccgcat

SEQ ID NO: 68365 - DNA, 20 bp, Artificial Sequence
  sgRNA
  NTC_3618
cggcgctatcggacgttgca

SEQ ID NO: 68366 - DNA, 20 bp, Artificial Sequence
  sgRNA
  NTC_3619
ggtgagatgtcgtagatacg

SEQ ID NO: 68367 - DNA, 20 bp, Artificial Sequence
  sgRNA
  NTC_3620
cgagcgatatcgatagcatt

SEQ ID NO: 68368 - DNA, 20 bp, Artificial Sequence
  sgRNA
  NTC_3621
tcgtaacagattcactacgc

SEQ ID NO: 68369 - DNA, 20 bp, Artificial Sequence
  sgRNA
  NTC_3622
gaagtggggtactcgatatg

SEQ ID NO: 68370 - DNA, 20 bp, Artificial Sequence
  sgRNA
  NTC_3623
gaacgtcacgcgaccgataa

SEQ ID NO: 68371 - DNA, 20 bp, Artificial Sequence
  sgRNA
  NTC_3624
cggagtgaggtgccgcgtta

SEQ ID NO: 68372 - DNA, 20 bp, Artificial Sequence
  sgRNA
  NTC_3625
ctacggcgagtaccgcgagt

SEQ ID NO: 68373 - DNA, 20 bp, Artificial Sequence
  sgRNA
  NTC_3626
gagcagcgtatcgaagatac

SEQ ID NO: 68374 - DNA, 20 bp, Artificial Sequence
  sgRNA
  NTC_3627
ggtgctagaaatacgatgat

SEQ ID NO: 68375 - DNA, 20 bp, Artificial Sequence
  sgRNA
  NTC_3628
cgcgctaataaatcgtcgcc

SEQ ID NO: 68376 - DNA, 20 bp, Artificial Sequence
  sgRNA
  NTC_3629
ggttacgcatgaacgatccg

SEQ ID NO: 68377 - DNA, 20 bp, Artificial Sequence
  sgRNA
  NTC_3630
ttcggtacggcataccatct

SEQ ID NO: 68378 - DNA, 20 bp, Artificial Sequence
  sgRNA
  NTC_3631
cgcgcagtgtcgaatcgtcg

SEQ ID NO: 68379 - DNA, 20 bp, Artificial Sequence
  sgRNA
  NTC_3632
ttcggcgagaaccgaatagc

SEQ ID NO: 68380 - DNA, 20 bp, Artificial Sequence
  sgRNA
  NTC_3633
cgcaatttctacgttatgcg

SEQ ID NO: 68381 - DNA, 20 bp, Artificial Sequence
  sgRNA
  NTC_3634
acgcaagggcgtgttacgtc

SEQ ID NO: 68382 - DNA, 20 bp, Artificial Sequence
  sgRNA
  NTC_3635
acgacacgctaccagcgcgt

SEQ ID NO: 68383 - DNA, 20 bp, Artificial Sequence
  sgRNA
  NTC_3636
gtcggatatagcatactcac

SEQ ID NO: 68384 - DNA, 20 bp, Artificial Sequence
  sgRNA
  NTC_3637
gttagacgctcttcgcgcct

SEQ ID NO: 68385 - DNA, 20 bp, Artificial Sequence
  sgRNA
  NTC_3638
tcggtacatagcgattgcgc

SEQ ID NO: 68386 - DNA, 20 bp, Artificial Sequence
  sgRNA
  NTC_3639
tcgggtcagcgcaagcgtca

SEQ ID NO: 68387 - DNA, 20 bp, Artificial Sequence
  sgRNA
  NTC_3640
taaattcgcgctcgattcac

SEQ ID NO: 68388 - DNA, 20 bp, Artificial Sequence
  sgRNA
  NTC_3641
gatcgagggaacgctcaatt

SEQ ID NO: 68389 - DNA, 20 bp, Artificial Sequence
  sgRNA
  NTC_3642
gttgtcgcgcgcacttcttt

SEQ ID NO: 68390 - DNA, 20 bp, Artificial Sequence
  sgRNA
  NTC_3643
attcaggacgcgccgcgcgt

SEQ ID NO: 68391 - DNA, 20 bp, Artificial Sequence
  sgRNA
  NTC_3644
tcggaggtttggaatccgtt

SEQ ID NO: 68392 - DNA, 20 bp, Artificial Sequence
  sgRNA
  NTC_3645
cgcgtgcacgcgagtaattg

SEQ ID NO: 68393 - DNA, 20 bp, Artificial Sequence
  sgRNA
  NTC_3646
tgcaacgtcgcgttatgaac

SEQ ID NO: 68394 - DNA, 20 bp, Artificial Sequence
  sgRNA
  NTC_3647
gaagtatcagtataccgtta

SEQ ID NO: 68395 - DNA, 20 bp, Artificial Sequence
  sgRNA
  NTC_3648
cgattcatcataccgcttcg

SEQ ID NO: 68396 - DNA, 20 bp, Artificial Sequence
  sgRNA
  NTC_3649
aaacggttggtacgcctgac

SEQ ID NO: 68397 - DNA, 20 bp, Artificial Sequence
  sgRNA
  NTC_3650
taatcgaggagtacgtccgc

SEQ ID NO: 68398 - DNA, 20 bp, Artificial Sequence
  sgRNA
  NTC_3651
cgtcgggaaacgtcccatac

SEQ ID NO: 68399 - DNA, 20 bp, Artificial Sequence
  sgRNA
  NTC_3652
gctcgttacacactccgtcg

SEQ ID NO: 68400 - DNA, 20 bp, Artificial Sequence
  sgRNA
  NTC_3653
gactaagcaacgcgccctcc

SEQ ID NO: 68401 - DNA, 20 bp, Artificial Sequence
  sgRNA
  NTC_3654
ctgatgtcgcgccgtcgtac

SEQ ID NO: 68402 - DNA, 20 bp, Artificial Sequence
  sgRNA
  NTC_3655
taggaacattcacccgagcg

SEQ ID NO: 68403 - DNA, 20 bp, Artificial Sequence
  sgRNA
  NTC_3656
aacgtcgcgatcccgacccg

SEQ ID NO: 68404 - DNA, 20 bp, Artificial Sequence
  sgRNA
  NTC_3657
cgttataagaatatgacgcg

SEQ ID NO: 68405 - DNA, 20 bp, Artificial Sequence
  sgRNA
  NTC_3658
cgtactgctatacgtactaa

SEQ ID NO: 68406 - DNA, 20 bp, Artificial Sequence
  sgRNA
  NTC_3659
cgcttagcgcggcgtgaatt

SEQ ID NO: 68407 - DNA, 20 bp, Artificial Sequence
  sgRNA
  NTC_3660
gactcacggcttatgcgcga

SEQ ID NO: 68408 - DNA, 20 bp, Artificial Sequence
  sgRNA
  NTC_3661
ttcgtgcgcgtgcattcgcc

SEQ ID NO: 68409 - DNA, 20 bp, Artificial Sequence
  sgRNA
  NTC_3662
tcgcaacgatcgtcccgaac

SEQ ID NO: 68410 - DNA, 20 bp, Artificial Sequence
  sgRNA
  NTC_3663
tgtcgacgtgcacgcgtacc

SEQ ID NO: 68411 - DNA, 20 bp, Artificial Sequence
  sgRNA
  NTC_3664
tgaggcgcgtatcataattg

SEQ ID NO: 68412 - DNA, 20 bp, Artificial Sequence
  sgRNA
  NTC_3665
ttggagggttagccgtttcg

SEQ ID NO: 68413 - DNA, 20 bp, Artificial Sequence
  sgRNA
  NTC_3666
acgcttgatgtgagtcgtac

SEQ ID NO: 68414 - DNA, 20 bp, Artificial Sequence
  sgRNA
  NTC_3667
gcgtgactagggcgcgtatt

SEQ ID NO: 68415 - DNA, 20 bp, Artificial Sequence
  sgRNA
  NTC_3668
aagcataagattcgcgcgct

SEQ ID NO: 68416 - DNA, 20 bp, Artificial Sequence
  sgRNA
  NTC_3669
tacgttgtacgccgctacaa

SEQ ID NO: 68417 - DNA, 20 bp, Artificial Sequence
  sgRNA
  NTC_3670
tttggacgagcgtgtacgtt

SEQ ID NO: 68418 - DNA, 20 bp, Artificial Sequence
  sgRNA
  NTC_3671
tatcgcggcgcgcgtaaccg

SEQ ID NO: 68419 - DNA, 20 bp, Artificial Sequence
  sgRNA
  NTC_3672
tatacttcgatgcgtcgcgt

SEQ ID NO: 68420 - DNA, 20 bp, Artificial Sequence
  sgRNA
  NTC_3673
tgtggcgtgggatgcgtcgt

SEQ ID NO: 68421 - DNA, 20 bp, Artificial Sequence
  sgRNA
  NTC_3674
gatcgtcttcggatccgcat

SEQ ID NO: 68422 - DNA, 20 bp, Artificial Sequence
  sgRNA
  NTC_3675
tcttcagtatgccgcgtcga

SEQ ID NO: 68423 - DNA, 20 bp, Artificial Sequence
  sgRNA
  NTC_3676
tctatgacttcgcgctatac

SEQ ID NO: 68424 - DNA, 20 bp, Artificial Sequence
  sgRNA
  NTC_3677
gtgtgtcgagatcacgtaag

SEQ ID NO: 68425 - DNA, 20 bp, Artificial Sequence
  sgRNA
  NTC_3678
cgcgaagaataacccgtaga

SEQ ID NO: 68426 - DNA, 20 bp, Artificial Sequence
  sgRNA
  NTC_3679
ggcgcaatcacaccgacagt

SEQ ID NO: 68427 - DNA, 20 bp, Artificial Sequence
  sgRNA
  NTC_3680
aatatcgtgttcgacgcagt

SEQ ID NO: 68428 - DNA, 20 bp, Artificial Sequence
  sgRNA
  NTC_3681
cgacgtgtacgcacgttgac

SEQ ID NO: 68429 - DNA, 20 bp, Artificial Sequence
  sgRNA
  NTC_3682
agctcggcgagcgtagcatt

SEQ ID NO: 68430 - DNA, 20 bp, Artificial Sequence
  sgRNA
  NTC_3683
aggatggagcatatcgcgta

SEQ ID NO: 68431 - DNA, 20 bp, Artificial Sequence
  sgRNA
  NTC_3684
acgtcgacgatcccgactta

SEQ ID NO: 68432 - DNA, 20 bp, Artificial Sequence
  sgRNA
  NTC_3685
agtctaagtagatccgactc

SEQ ID NO: 68433 - DNA, 20 bp, Artificial Sequence
  sgRNA
  NTC_3686
cttcgtcgtaaagcgcatcg

SEQ ID NO: 68434 - DNA, 20 bp, Artificial Sequence
  sgRNA
  NTC_3687
tgggttgcgcgccaacttcg

SEQ ID NO: 68435 - DNA, 20 bp, Artificial Sequence
  sgRNA
  NTC_3688
ttgactagcactcgatcgac

SEQ ID NO: 68436 - DNA, 20 bp, Artificial Sequence
  sgRNA
  NTC_3689
gctatgggttcttccgttcg

SEQ ID NO: 68437 - DNA, 20 bp, Artificial Sequence
  sgRNA
  NTC_3690
gcatgttacacgattaacga

SEQ ID NO: 68438 - DNA, 20 bp, Artificial Sequence
  sgRNA
  NTC_3691
gctgatggcgcaccgttata

SEQ ID NO: 68439 - DNA, 20 bp, Artificial Sequence
  sgRNA
  NTC_3692
cgcacggatacgtcgacgag

SEQ ID NO: 68440 - DNA, 20 bp, Artificial Sequence
  sgRNA
  NTC_3693
tatgcggggacgccccgttc

SEQ ID NO: 68441 - DNA, 20 bp, Artificial Sequence
  sgRNA
  NTC_3694
cgaagttacggctacgaaaa

SEQ ID NO: 68442 - DNA, 20 bp, Artificial Sequence
  sgRNA
  NTC_3695
tactacggtcgttcgaagca

SEQ ID NO: 68443 - DNA, 20 bp, Artificial Sequence
  sgRNA
  NTC_3696
tagacgctgagtcgcttcat

SEQ ID NO: 68444 - DNA, 20 bp, Artificial Sequence
  sgRNA
  NTC_3697
ggtgtaacagcgcgagcact

SEQ ID NO: 68445 - DNA, 20 bp, Artificial Sequence
  sgRNA
  NTC_3698
acgaatctgtacgcaaacta

SEQ ID NO: 68446 - DNA, 20 bp, Artificial Sequence
  sgRNA
  NTC_3699
taggggtcgggtcgcgtcga

SEQ ID NO: 68447 - DNA, 20 bp, Artificial Sequence
  sgRNA
  NTC_3700
agggattgtgcgcgcgaacc

SEQ ID NO: 68448 - DNA, 20 bp, Artificial Sequence
  sgRNA
  NTC_3701
ggcaacgcatcgacgcttgt

SEQ ID NO: 68449 - DNA, 20 bp, Artificial Sequence
  sgRNA
  NTC_3702
actgtaaggggacccctcgt

SEQ ID NO: 68450 - DNA, 20 bp, Artificial Sequence
  sgRNA
  NTC_3703
cacgtactgtgagccgtctt

SEQ ID NO: 68451 - DNA, 20 bp, Artificial Sequence
  sgRNA
  NTC_3704
ttcggcgagtatcgtcctac

SEQ ID NO: 68452 - DNA, 20 bp, Artificial Sequence
  sgRNA
  NTC_3705
tcggtttacgcgtgaaaccg

SEQ ID NO: 68453 - DNA, 20 bp, Artificial Sequence
  sgRNA
  NTC_3706
tcgtattggctgtgcatcga

SEQ ID NO: 68454 - DNA, 20 bp, Artificial Sequence
  sgRNA
  NTC_3707
tcatcgcaacgcgtccctag

SEQ ID NO: 68455 - DNA, 20 bp, Artificial Sequence
  sgRNA
  NTC_3708
gtcgaaagcgcgtccagcat

SEQ ID NO: 68456 - DNA, 20 bp, Artificial Sequence
  sgRNA
  NTC_3709
acatcgagacaacgcgattg

SEQ ID NO: 68457 - DNA, 20 bp, Artificial Sequence
  sgRNA
  NTC_3710
tagttggattcgcgaaccgt

SEQ ID NO: 68458 - DNA, 20 bp, Artificial Sequence
  sgRNA
  NTC_3711
tggagcagtactcgcgccct

SEQ ID NO: 68459 - DNA, 20 bp, Artificial Sequence
  sgRNA
  NTC_3712
ctttggtattagttcgcgac

SEQ ID NO: 68460 - DNA, 20 bp, Artificial Sequence
  sgRNA
  NTC_3713
atcgttacgtagtccccgcg

SEQ ID NO: 68461 - DNA, 20 bp, Artificial Sequence
  sgRNA
  NTC_3714
atgctaggcaggtcgcgatc

SEQ ID NO: 68462 - DNA, 20 bp, Artificial Sequence
  sgRNA
  NTC_3715
aaatcgttagtgcgacgtcc

SEQ ID NO: 68463 - DNA, 20 bp, Artificial Sequence
  sgRNA
  NTC_3716
gaacgacaagcgtcgacgca

SEQ ID NO: 68464 - DNA, 20 bp, Artificial Sequence
  sgRNA
  NTC_3717
tcgtctaggcgaatcataat

SEQ ID NO: 68465 - DNA, 20 bp, Artificial Sequence
  sgRNA
  NTC_3718
tgctgcacgtggaccgacgt

SEQ ID NO: 68466 - DNA, 20 bp, Artificial Sequence
  sgRNA
  NTC_3719
agcgagataatcgcacatac

SEQ ID NO: 68467 - DNA, 20 bp, Artificial Sequence
  sgRNA
  NTC_3720
atgtcttcgctcaacgagtc

SEQ ID NO: 68468 - DNA, 20 bp, Artificial Sequence
  sgRNA
  NTC_3721
tgtcgggtgtaattacgacg

SEQ ID NO: 68469 - DNA, 20 bp, Artificial Sequence
  sgRNA
  NTC_3722
tgcgtgcgggacttattaca

SEQ ID NO: 68470 - DNA, 20 bp, Artificial Sequence
  sgRNA
  NTC_3723
cgcgacgagcgcacaaacaa

SEQ ID NO: 68471 - DNA, 20 bp, Artificial Sequence
  sgRNA
  NTC_3724
cagctggagtaatcgacgtc

SEQ ID NO: 68472 - DNA, 20 bp, Artificial Sequence
  sgRNA
  NTC_3725
ggcgacgctttcccgagtct

SEQ ID NO: 68473 - DNA, 20 bp, Artificial Sequence
  sgRNA
  NTC_3726
tagggacgaaatatcgcgcc

SEQ ID NO: 68474 - DNA, 20 bp, Artificial Sequence
  sgRNA
  NTC_3727
cggacggtatgccccgaaac

SEQ ID NO: 68475 - DNA, 20 bp, Artificial Sequence
  sgRNA
  NTC_3728
gttaatggctagtccgaaac

SEQ ID NO: 68476 - DNA, 20 bp, Artificial Sequence
  sgRNA
  NTC_3729
ggtcggggtcaaccgaacta

SEQ ID NO: 68477 - DNA, 20 bp, Artificial Sequence
  sgRNA
  NTC_3730
gtcggcgaattcgataccta

SEQ ID NO: 68478 - DNA, 20 bp, Artificial Sequence
  sgRNA
  NTC_3731
tgagacgtcgggcgcgtatt

SEQ ID NO: 68479 - DNA, 20 bp, Artificial Sequence
  sgRNA
  NTC_3732
tcgcgtagtgttgaacaccg

SEQ ID NO: 68480 - DNA, 20 bp, Artificial Sequence
  sgRNA
  NTC_3733
cgagtagaagcgcgtaccgt

SEQ ID NO: 68481 - DNA, 20 bp, Artificial Sequence
  sgRNA
  NTC_3734
cgcgtatgcggtagcgtcag

SEQ ID NO: 68482 - DNA, 20 bp, Artificial Sequence
  sgRNA
  NTC_3735
gcggttacgtaaacgctgat

SEQ ID NO: 68483 - DNA, 20 bp, Artificial Sequence
  sgRNA
  NTC_3736
ggcgaggatagcgctcgcta

SEQ ID NO: 68484 - DNA, 20 bp, Artificial Sequence
  sgRNA
  NTC_3737
tcggcggcgaatgcgttatt

SEQ ID NO: 68485 - DNA, 20 bp, Artificial Sequence
  sgRNA
  NTC_3738
gcggctgggcgtcgcgagta

SEQ ID NO: 68486 - DNA, 20 bp, Artificial Sequence
  sgRNA
  NTC_3739
agctctcagtatgacgcgcg

SEQ ID NO: 68487 - DNA, 20 bp, Artificial Sequence
  sgRNA
  NTC_3740
tttaggcgggcgctaacaat

SEQ ID NO: 68488 - DNA, 20 bp, Artificial Sequence
  sgRNA
  NTC_3741
tggtactcgcgctacgcccg

SEQ ID NO: 68489 - DNA, 20 bp, Artificial Sequence
  sgRNA
  NTC_3742
atacgttcgatctcacgcga

SEQ ID NO: 68490 - DNA, 20 bp, Artificial Sequence
  sgRNA
  NTC_3743
gcactggagggcgattgacg

SEQ ID NO: 68491 - DNA, 20 bp, Artificial Sequence
  sgRNA
  NTC_3744
ggacggacttcgtttacgtc

SEQ ID NO: 68492 - DNA, 20 bp, Artificial Sequence
  sgRNA
  NTC_3745
acgttcgggtcaactgcgtc

SEQ ID NO: 68493 - DNA, 20 bp, Artificial Sequence
  sgRNA
  NTC_3746
caatgcgctttagtcgctag

SEQ ID NO: 68494 - DNA, 20 bp, Artificial Sequence
  sgRNA
  NTC_3747
gtctcattcgtctactcgcg

SEQ ID NO: 68495 - DNA, 20 bp, Artificial Sequence
  sgRNA
  NTC_3748
ggtatgcgacaacgcaaatt

SEQ ID NO: 68496 - DNA, 20 bp, Artificial Sequence
  sgRNA
  NTC_3749
cgaaagtgcgttgttcgcga

SEQ ID NO: 68497 - DNA, 20 bp, Artificial Sequence
  sgRNA
  NTC_3750
ggatatacttgcgcgcaccg

SEQ ID NO: 68498 - DNA, 20 bp, Artificial Sequence
  sgRNA
  NTC_3751
ctctcgacaacgcccttaat

SEQ ID NO: 68499 - DNA, 20 bp, Artificial Sequence
  sgRNA
  NTC_3752
agttcagtgtgcgtcgcctc

SEQ ID NO: 68500 - DNA, 20 bp, Artificial Sequence
  sgRNA
  NTC_3753
tactgtcgcgatcatagtcg

SEQ ID NO: 68501 - DNA, 20 bp, Artificial Sequence
  sgRNA
  NTC_3754
cgtcggtgctcgagtcagcg

SEQ ID NO: 68502 - DNA, 20 bp, Artificial Sequence
  sgRNA
  NTC_3755
tcaatacattgtcgcgccgt

SEQ ID NO: 68503 - DNA, 20 bp, Artificial Sequence
  sgRNA
  NTC_3756
ggatacgcgtcgtgccgcac

SEQ ID NO: 68504 - DNA, 20 bp, Artificial Sequence
  sgRNA
  NTC_3757
cgctacacgagccgcaatat

SEQ ID NO: 68505 - DNA, 20 bp, Artificial Sequence
  sgRNA
  NTC_3758
gatttgaaagtcgacgccta

SEQ ID NO: 68506 - DNA, 20 bp, Artificial Sequence
  sgRNA
  NTC_3759
acgctgcacggccatccgat

SEQ ID NO: 68507 - DNA, 20 bp, Artificial Sequence
  sgRNA
  NTC_3760
atcgtacgatcgttcgcgtg

SEQ ID NO: 68508 - DNA, 20 bp, Artificial Sequence
  sgRNA
  NTC_3761
gcgtttgcaagactcgattg

SEQ ID NO: 68509 - DNA, 20 bp, Artificial Sequence
  sgRNA
  NTC_3762
tgatatacggtcgtgatccg

SEQ ID NO: 68510 - DNA, 20 bp, Artificial Sequence
  sgRNA
  NTC_3763
cgatacgaacggccttgagc

SEQ ID NO: 68511 - DNA, 20 bp, Artificial Sequence
  sgRNA
  NTC_3764
ttcgacacttcgcgccgcgc

SEQ ID NO: 68512 - DNA, 20 bp, Artificial Sequence
  sgRNA
  NTC_3765
actaggttgaatcgcatcgc

SEQ ID NO: 68513 - DNA, 20 bp, Artificial Sequence
  sgRNA
  NTC_3766
cgctttgcaaactacgcgcc

SEQ ID NO: 68514 - DNA, 20 bp, Artificial Sequence
  sgRNA
  NTC_3767
gctagaggtatgattcgtcg

SEQ ID NO: 68515 - DNA, 20 bp, Artificial Sequence
  sgRNA
  NTC_3768
cggcagaactttagtcgccg

SEQ ID NO: 68516 - DNA, 20 bp, Artificial Sequence
  sgRNA
  NTC_3769
ctggcaacgcggtcgaactc

SEQ ID NO: 68517 - DNA, 20 bp, Artificial Sequence
  sgRNA
  NTC_3770
cgagtgacgtagtccgattt

SEQ ID NO: 68518 - DNA, 20 bp, Artificial Sequence
  sgRNA
  NTC_3771
acaatatgtggcaacgcgtc

SEQ ID NO: 68519 - DNA, 20 bp, Artificial Sequence
  sgRNA
  NTC_3772
gtagagaggcatcccgtaat

SEQ ID NO: 68520 - DNA, 20 bp, Artificial Sequence
  sgRNA
  NTC_3773
tcagtttaacgcgcacgatt

SEQ ID NO: 68521 - DNA, 20 bp, Artificial Sequence
  sgRNA
  NTC_3774
ttggtgtgattcgactaagt

SEQ ID NO: 68522 - DNA, 20 bp, Artificial Sequence
  sgRNA
  NTC_3775
aacggacttcgccgcttcta

SEQ ID NO: 68523 - DNA, 20 bp, Artificial Sequence
  sgRNA
  NTC_3776
actgttagatagtcgtcgcg

SEQ ID NO: 68524 - DNA, 20 bp, Artificial Sequence
  sgRNA
  NTC_3777
tgacacgcgacttgctgtcg

SEQ ID NO: 68525 - DNA, 20 bp, Artificial Sequence
  sgRNA
  NTC_3778
gcggtggacggtcgttcatt

SEQ ID NO: 68526 - DNA, 20 bp, Artificial Sequence
  sgRNA
  NTC_3779
cagcgtctcacgatcgactg

SEQ ID NO: 68527 - DNA, 20 bp, Artificial Sequence
  sgRNA
  NTC_3780
actacggcgtatatgcgatc

SEQ ID NO: 68528 - DNA, 20 bp, Artificial Sequence
  sgRNA
  NTC_3781
tgtcgcgcgtacgaattaaa

SEQ ID NO: 68529 - DNA, 20 bp, Artificial Sequence
  sgRNA
  NTC_3782
acggtcaaaaatcgctgtcg

SEQ ID NO: 68530 - DNA, 20 bp, Artificial Sequence
  sgRNA
  NTC_3783
gggtctgcggaacgaacgat

SEQ ID NO: 68531 - DNA, 20 bp, Artificial Sequence
  sgRNA
  NTC_3784
ggttaatgattcgtcgcgtt

SEQ ID NO: 68532 - DNA, 20 bp, Artificial Sequence
  sgRNA
  NTC_3785
ggtagatcgattcgtacacg

SEQ ID NO: 68533 - DNA, 20 bp, Artificial Sequence
  sgRNA
  NTC_3786
ggtcgagcggtaatgtccgt

SEQ ID NO: 68534 - DNA, 20 bp, Artificial Sequence
  sgRNA
  NTC_3787
aggttaggttacgacgttga

SEQ ID NO: 68535 - DNA, 20 bp, Artificial Sequence
  sgRNA
  NTC_3788
tttcgggtcagttgcgagta

SEQ ID NO: 68536 - DNA, 20 bp, Artificial Sequence
  sgRNA
  NTC_3789
atagactgtttaagtcgcgc

SEQ ID NO: 68537 - DNA, 20 bp, Artificial Sequence
  sgRNA
  NTC_3790
cggagagtgatcgcgtacta

SEQ ID NO: 68538 - DNA, 20 bp, Artificial Sequence
  sgRNA
  NTC_3791
cgggtattctcgttacgagt

SEQ ID NO: 68539 - DNA, 20 bp, Artificial Sequence
  sgRNA
  NTC_3792
tcaacgcgataccagtagcg

SEQ ID NO: 68540 - DNA, 20 bp, Artificial Sequence
  sgRNA
  NTC_3793
attatgttggtacgcaccgt

SEQ ID NO: 68541 - DNA, 20 bp, Artificial Sequence
  sgRNA
  NTC_3794
gttacgtacggaccgcccga

SEQ ID NO: 68542 - DNA, 20 bp, Artificial Sequence
  sgRNA
  NTC_3795
gatttgtgcgcgtacgcact

SEQ ID NO: 68543 - DNA, 20 bp, Artificial Sequence
  sgRNA
  NTC_3796
gttcgaacgattagcccgcc

SEQ ID NO: 68544 - DNA, 20 bp, Artificial Sequence
  sgRNA
  NTC_3797
gatcagtcttgccccgcgct

SEQ ID NO: 68545 - DNA, 20 bp, Artificial Sequence
  sgRNA
  NTC_3798
tatcatcgtcgcgattatta

SEQ ID NO: 68546 - DNA, 20 bp, Artificial Sequence
  sgRNA
  NTC_3799
tgtgcgacgaagtcgttcac

SEQ ID NO: 68547 - DNA, 20 bp, Artificial Sequence
  sgRNA
  NTC_3800
cggcgcattaggaatcgact

SEQ ID NO: 68548 - DNA, 20 bp, Artificial Sequence
  sgRNA
  NTC_3801
gatctcgatcgcgattaacg

SEQ ID NO: 68549 - DNA, 20 bp, Artificial Sequence
  sgRNA
  NTC_3802
tgctaggcattccgttcatc

SEQ ID NO: 68550 - DNA, 20 bp, Artificial Sequence
  sgRNA
  NTC_3803
tcttcgatcaatccgcgacc

SEQ ID NO: 68551 - DNA, 20 bp, Artificial Sequence
  sgRNA
  NTC_3804
gactgaacggacattcgatc

SEQ ID NO: 68552 - DNA, 20 bp, Artificial Sequence
  sgRNA
  NTC_3805
acgttgagtaatccgcatgt

SEQ ID NO: 68553 - DNA, 20 bp, Artificial Sequence
  sgRNA
  NTC_3806
acgtaacgagggtagtcgtg

SEQ ID NO: 68554 - DNA, 20 bp, Artificial Sequence
  sgRNA
  NTC_3807
actatcgatcggccgcgtca

SEQ ID NO: 68555 - DNA, 20 bp, Artificial Sequence
  sgRNA
  NTC_3808
tgtctacagttacgccgatc

SEQ ID NO: 68556 - DNA, 20 bp, Artificial Sequence
  sgRNA
  NTC_3809
tgggctttatacgccgcgac

SEQ ID NO: 68557 - DNA, 20 bp, Artificial Sequence
  sgRNA
  NTC_3810
tcggcatcgatattcgttcc

SEQ ID NO: 68558 - DNA, 20 bp, Artificial Sequence
  sgRNA
  NTC_3811
ttgacgcgcgctgatcgccc

SEQ ID NO: 68559 - DNA, 20 bp, Artificial Sequence
  sgRNA
  NTC_3812
cacgttgcgctttacgcacc

SEQ ID NO: 68560 - DNA, 20 bp, Artificial Sequence
  sgRNA
  NTC_3813
gactgacatcataccgactt

SEQ ID NO: 68561 - DNA, 20 bp, Artificial Sequence
  sgRNA
  NTC_3814
agttagcacgggaccgactt

SEQ ID NO: 68562 - DNA, 20 bp, Artificial Sequence
  sgRNA
  NTC_3815
acgctcgagttgagcgcctt

SEQ ID NO: 68563 - DNA, 20 bp, Artificial Sequence
  sgRNA
  NTC_3816
aactgcatgcttcgcgttag

SEQ ID NO: 68564 - DNA, 20 bp, Artificial Sequence
  sgRNA
  NTC_3817
gcaactcgcggagcactact

SEQ ID NO: 68565 - DNA, 20 bp, Artificial Sequence
  sgRNA
  NTC_3818
tggataggatcgacgaccgt

SEQ ID NO: 68566 - DNA, 20 bp, Artificial Sequence
  sgRNA
  NTC_3819
gtcggtgtagttaattcgcg

SEQ ID NO: 68567 - DNA, 20 bp, Artificial Sequence
  sgRNA
  NTC_3820
gcgcgcgcgcacgattcgtt

SEQ ID NO: 68568 - DNA, 20 bp, Artificial Sequence
  sgRNA
  NTC_3821
gtctcgttcaattcgcgtat

SEQ ID NO: 68569 - DNA, 20 bp, Artificial Sequence
  sgRNA
  NTC_3822
taacgcgtcaatcgttagca

SEQ ID NO: 68570 - DNA, 20 bp, Artificial Sequence
  sgRNA
  NTC_3823
aactaggatcacgctacgcg

SEQ ID NO: 68571 - DNA, 20 bp, Artificial Sequence
  sgRNA
  NTC_3824
ggttcgcaggtgactcgatt

SEQ ID NO: 68572 - DNA, 20 bp, Artificial Sequence
  sgRNA
  NTC_3825
ttacgaacggtgataatgtc

SEQ ID NO: 68573 - DNA, 20 bp, Artificial Sequence
  sgRNA
  NTC_3826
gcgaaactttgagacgccct

SEQ ID NO: 68574 - DNA, 20 bp, Artificial Sequence
  sgRNA
  NTC_3827
aatcacgcgcgttgagccct

SEQ ID NO: 68575 - DNA, 20 bp, Artificial Sequence
  sgRNA
  NTC_3828
tgacgcgcgtatcctgtacg

SEQ ID NO: 68576 - DNA, 20 bp, Artificial Sequence
  sgRNA
  NTC_3829
gcgaattatagtgccgcgcg

SEQ ID NO: 68577 - DNA, 20 bp, Artificial Sequence
  sgRNA
  NTC_3830
tcgtgctgtagatcgcgtaa

SEQ ID NO: 68578 - DNA, 20 bp, Artificial Sequence
  sgRNA
  NTC_3831
tcgggggagtattgcgtgtc

SEQ ID NO: 68579 - DNA, 20 bp, Artificial Sequence
  sgRNA
  NTC_3832
tgcgttaagtcgtaatgacc

SEQ ID NO: 68580 - DNA, 20 bp, Artificial Sequence
  sgRNA
  NTC_3833
cggtcgttcggtcacgtacg

SEQ ID NO: 68581 - DNA, 20 bp, Artificial Sequence
  sgRNA
  NTC_3834
ggacgtgtcgcgtcgtccag

SEQ ID NO: 68582 - DNA, 20 bp, Artificial Sequence
  sgRNA
  NTC_3835
acgatcacggactcaactag

SEQ ID NO: 68583 - DNA, 20 bp, Artificial Sequence
  sgRNA
  NTC_3836
agtagcttacatcgccgacg

SEQ ID NO: 68584 - DNA, 20 bp, Artificial Sequence
  sgRNA
  NTC_3837
tcatgacgtcgaacgacacg

SEQ ID NO: 68585 - DNA, 20 bp, Artificial Sequence
  sgRNA
  NTC_3838
gtgcgttcgtagcgcctctt

SEQ ID NO: 68586 - DNA, 20 bp, Artificial Sequence
  sgRNA
  NTC_3839
gtgaagacgcgatgcgcgac

SEQ ID NO: 68587 - DNA, 20 bp, Artificial Sequence
  sgRNA
  NTC_3840
aattgcgtatttcttcgcga

SEQ ID NO: 68588 - DNA, 20 bp, Artificial Sequence
  sgRNA
  NTC_3841
ggtgcgtgaaatcgttatag

SEQ ID NO: 68589 - DNA, 20 bp, Artificial Sequence
  sgRNA
  NTC_3842
tcgcgcggcatcctgttgcg

SEQ ID NO: 68590 - DNA, 20 bp, Artificial Sequence
  sgRNA
  NTC_3843
cgatcggttagtctacatta

SEQ ID NO: 68591 - DNA, 20 bp, Artificial Sequence
  sgRNA
  NTC_3844
aatcgtacgttcctcgtacg

SEQ ID NO: 68592 - DNA, 20 bp, Artificial Sequence
  sgRNA
  NTC_3845
actatagcgggtgtaacgcc

SEQ ID NO: 68593 - DNA, 20 bp, Artificial Sequence
  sgRNA
  NTC_3846
aatagtcgaagaacccgtcc

SEQ ID NO: 68594 - DNA, 20 bp, Artificial Sequence
  sgRNA
  NTC_3847
tcgactttgagacacgtcaa

SEQ ID NO: 68595 - DNA, 20 bp, Artificial Sequence
  sgRNA
  NTC_3848
ggagtaaatgatttcgatcg

SEQ ID NO: 68596 - DNA, 20 bp, Artificial Sequence
  sgRNA
  NTC_3849
ggcgcggtacatcatcaacc

SEQ ID NO: 68597 - DNA, 20 bp, Artificial Sequence
  sgRNA
  NTC_3850
acgcagaggctcgacatccg

SEQ ID NO: 68598 - DNA, 20 bp, Artificial Sequence
  sgRNA
  NTC_3851
acgtgcttcaacagcgatac

SEQ ID NO: 68599 - DNA, 20 bp, Artificial Sequence
  sgRNA
  NTC_3852
cttaattagagtatcgccgt

SEQ ID NO: 68600 - DNA, 20 bp, Artificial Sequence
  sgRNA
  NTC_3853
taacgagcgtagatcgagcg

SEQ ID NO: 68601 - DNA, 20 bp, Artificial Sequence
  sgRNA
  NTC_3854
cgcgtgaattagccacgaat

SEQ ID NO: 68602 - DNA, 20 bp, Artificial Sequence
  sgRNA
  NTC_3855
ggaaatgagcacgtcgaacg

SEQ ID NO: 68603 - DNA, 20 bp, Artificial Sequence
  sgRNA
  NTC_3856
ggctttcacgaaatcgcagt

SEQ ID NO: 68604 - DNA, 20 bp, Artificial Sequence
  sgRNA
  NTC_3857
catttgacgtaaccgcgcgc

SEQ ID NO: 68605 - DNA, 20 bp, Artificial Sequence
  sgRNA
  NTC_3858
cggcatggataacgctatct

SEQ ID NO: 68606 - DNA, 20 bp, Artificial Sequence
  sgRNA
  NTC_3859
cattgcgtgtgcaccgttac

SEQ ID NO: 68607 - DNA, 20 bp, Artificial Sequence
  sgRNA
  NTC_3860
atgaaagcgcgcgattacga

SEQ ID NO: 68608 - DNA, 20 bp, Artificial Sequence
  sgRNA
  NTC_3861
ctattagcggcgccgttcga

SEQ ID NO: 68609 - DNA, 20 bp, Artificial Sequence
  sgRNA
  NTC_3862
gatatagtgtagcgatccga

SEQ ID NO: 68610 - DNA, 20 bp, Artificial Sequence
  sgRNA
  NTC_3863
gtcgtggggtgccttacgat

SEQ ID NO: 68611 - DNA, 20 bp, Artificial Sequence
  sgRNA
  NTC_3864
ggattcgtattattcgcacg

SEQ ID NO: 68612 - DNA, 20 bp, Artificial Sequence
  sgRNA
  NTC_3865
ctcatgctgacgccgcgatg

SEQ ID NO: 68613 - DNA, 20 bp, Artificial Sequence
  sgRNA
  NTC_3866
atgtactaggcgcgatatcc

SEQ ID NO: 68614 - DNA, 20 bp, Artificial Sequence
  sgRNA
  NTC_3867
tcgtgcgcatcatcgtcgta

SEQ ID NO: 68615 - DNA, 20 bp, Artificial Sequence
  sgRNA
  NTC_3868
gctgtagcacgaaacgcgta

SEQ ID NO: 68616 - DNA, 20 bp, Artificial Sequence
  sgRNA
  NTC_3869
ggtgcacgaagcctcgttag

SEQ ID NO: 68617 - DNA, 20 bp, Artificial Sequence
  sgRNA
  NTC_3870
cagggcgaatcgcgccagta

SEQ ID NO: 68618 - DNA, 20 bp, Artificial Sequence
  sgRNA
  NTC_3871
gtcacgcaataacgcccgaa

SEQ ID NO: 68619 - DNA, 20 bp, Artificial Sequence
  sgRNA
  NTC_3872
ctcgtctacaacgctcagcg

SEQ ID NO: 68620 - DNA, 20 bp, Artificial Sequence
  sgRNA
  NTC_3873
tactatgactgatcgtacgc

SEQ ID NO: 68621 - DNA, 20 bp, Artificial Sequence
  sgRNA
  NTC_3874
gcgagtgtagcgattcgcgt

SEQ ID NO: 68622 - DNA, 20 bp, Artificial Sequence
  sgRNA
  NTC_3875
atacatcgttcttgcgtagc

SEQ ID NO: 68623 - DNA, 20 bp, Artificial Sequence
  sgRNA
  NTC_3876
acgattcgcggacttctttc

SEQ ID NO: 68624 - DNA, 20 bp, Artificial Sequence
  sgRNA
  NTC_3877
tctgaaagttcgcgtcgcac

SEQ ID NO: 68625 - DNA, 20 bp, Artificial Sequence
  sgRNA
  NTC_3878
ctgatcatggtaagcgccga

SEQ ID NO: 68626 - DNA, 20 bp, Artificial Sequence
  sgRNA
  NTC_3879
gatgcacataagcgtcgtaa

SEQ ID NO: 68627 - DNA, 20 bp, Artificial Sequence
  sgRNA
  NTC_3880
gcacgactttacgcgtacaa

SEQ ID NO: 68628 - DNA, 20 bp, Artificial Sequence
  sgRNA
  NTC_3881
ttcttaacgcggtgtacgag

SEQ ID NO: 68629 - DNA, 20 bp, Artificial Sequence
  sgRNA
  NTC_3882
ttgctatgcgacgccaatcg

SEQ ID NO: 68630 - DNA, 20 bp, Artificial Sequence
  sgRNA
  NTC_3883
gcgcggggatatcccgtcac

SEQ ID NO: 68631 - DNA, 20 bp, Artificial Sequence
  sgRNA
  NTC_3884
tactgtcatggcaccgaaac

SEQ ID NO: 68632 - DNA, 20 bp, Artificial Sequence
  sgRNA
  NTC_3885
tgggcaaaaacgtacaacgc

SEQ ID NO: 68633 - DNA, 20 bp, Artificial Sequence
  sgRNA
  NTC_3886
attacgatcgcgaccgctcc

SEQ ID NO: 68634 - DNA, 20 bp, Artificial Sequence
  sgRNA
  NTC_3887
ttgcgcgtattacctccgct

SEQ ID NO: 68635 - DNA, 20 bp, Artificial Sequence
  sgRNA
  NTC_3888
aaggcggcgatcgacgactc

SEQ ID NO: 68636 - DNA, 20 bp, Artificial Sequence
  sgRNA
  NTC_3889
tgcgtcgcgagagttcgacc

SEQ ID NO: 68637 - DNA, 20 bp, Artificial Sequence
  sgRNA
  NTC_3890
tttgcgctgtaaagccctac

SEQ ID NO: 68638 - DNA, 20 bp, Artificial Sequence
  sgRNA
  NTC_3891
gggctaacggtacagacgcc

SEQ ID NO: 68639 - DNA, 20 bp, Artificial Sequence
  sgRNA
  NTC_3892
gacttattgaggcgtacact

SEQ ID NO: 68640 - DNA, 20 bp, Artificial Sequence
  sgRNA
  NTC_3893
gtcggctaactgatccgcga

SEQ ID NO: 68641 - DNA, 20 bp, Artificial Sequence
  sgRNA
  NTC_3894
attagtacacgatacgcgca

SEQ ID NO: 68642 - DNA, 20 bp, Artificial Sequence
  sgRNA
  NTC_3895
acgtcaagctctgcgttgcc

SEQ ID NO: 68643 - DNA, 20 bp, Artificial Sequence
  sgRNA
  NTC_3896
ggtcgcactagctcgcgact

SEQ ID NO: 68644 - DNA, 20 bp, Artificial Sequence
  sgRNA
  NTC_3897
ataggcatgtcgctacaaat

SEQ ID NO: 68645 - DNA, 20 bp, Artificial Sequence
  sgRNA
  NTC_3898
taatgttgcgggcgcccgtc

SEQ ID NO: 68646 - DNA, 20 bp, Artificial Sequence
  sgRNA
  NTC_3899
cggatcactggccccaaatt

SEQ ID NO: 68647 - DNA, 20 bp, Artificial Sequence
  sgRNA
  NTC_3900
tcgcgaaacttaatgcttgc

SEQ ID NO: 68648 - DNA, 20 bp, Artificial Sequence
  sgRNA
  NTC_3901
atcttcgcgtgctacgagcg

SEQ ID NO: 68649 - DNA, 20 bp, Artificial Sequence
  sgRNA
  NTC_3902
ggttagtaaacacgcccgtc

SEQ ID NO: 68650 - DNA, 20 bp, Artificial Sequence
  sgRNA
  NTC_3903
taagtcgcggttaaacgaat

SEQ ID NO: 68651 - DNA, 20 bp, Artificial Sequence
  sgRNA
  NTC_3904
ctgtaattaagctgcgatag

SEQ ID NO: 68652 - DNA, 20 bp, Artificial Sequence
  sgRNA
  NTC_3905
tcgtcgggcatgcttaatgc

SEQ ID NO: 68653 - DNA, 20 bp, Artificial Sequence
  sgRNA
  NTC_3906
cgcggatcgtttgttgagct

SEQ ID NO: 68654 - DNA, 20 bp, Artificial Sequence
  sgRNA
  NTC_3907
aggtacgtcttgcacgctcg

SEQ ID NO: 68655 - DNA, 20 bp, Artificial Sequence
  sgRNA
  NTC_3908
cggtctaatactagtccgat

SEQ ID NO: 68656 - DNA, 20 bp, Artificial Sequence
  sgRNA
  NTC_3909
atgcgaacgactcaactcat

SEQ ID NO: 68657 - DNA, 20 bp, Artificial Sequence
  sgRNA
  NTC_3910
gctcgcggctagtacgatcc

SEQ ID NO: 68658 - DNA, 20 bp, Artificial Sequence
  sgRNA
  NTC_3911
atttagggttcgcgcctaac

SEQ ID NO: 68659 - DNA, 20 bp, Artificial Sequence
  sgRNA
  NTC_3912
cgtcgctgataagccaatac

SEQ ID NO: 68660 - DNA, 20 bp, Artificial Sequence
  sgRNA
  NTC_3913
tcgctacgaatcagtcgacc

SEQ ID NO: 68661 - DNA, 20 bp, Artificial Sequence
  sgRNA
  NTC_3914
gggcgattcgtcgataatgt

SEQ ID NO: 68662 - DNA, 20 bp, Artificial Sequence
  sgRNA
  NTC_3915
aattggcgtctccccgtaga

SEQ ID NO: 68663 - DNA, 20 bp, Artificial Sequence
  sgRNA
  NTC_3916
cgaataacaacgcttcgcac

SEQ ID NO: 68664 - DNA, 20 bp, Artificial Sequence
  sgRNA
  NTC_3917
gggtcgcgttcgcgccttac

SEQ ID NO: 68665 - DNA, 20 bp, Artificial Sequence
  sgRNA
  NTC_3918
cggcacgtgggccgaaaacg

SEQ ID NO: 68666 - DNA, 20 bp, Artificial Sequence
  sgRNA
  NTC_3919
gcgcgtagaatcgcccacct

SEQ ID NO: 68667 - DNA, 20 bp, Artificial Sequence
  sgRNA
  NTC_3920
gctattaacggctttgacgc

SEQ ID NO: 68668 - DNA, 20 bp, Artificial Sequence
  sgRNA
  NTC_3921
tctagcgcggtagtcgttgc

SEQ ID NO: 68669 - DNA, 20 bp, Artificial Sequence
  sgRNA
  NTC_3922
agtggtctttcgcatcgagt

SEQ ID NO: 68670 - DNA, 20 bp, Artificial Sequence
  sgRNA
  NTC_3923
gatcgacgttagacgtcgcg

SEQ ID NO: 68671 - DNA, 20 bp, Artificial Sequence
  sgRNA
  NTC_3924
ttagactactctcgcgcgac

SEQ ID NO: 68672 - DNA, 20 bp, Artificial Sequence
  sgRNA
  NTC_3925
ttggttagtcgcgccgttac

SEQ ID NO: 68673 - DNA, 20 bp, Artificial Sequence
  sgRNA
  NTC_3926
gggttcaaacgatacgaatc

SEQ ID NO: 68674 - DNA, 20 bp, Artificial Sequence
  sgRNA
  NTC_3927
atagtgtggcgcctatctcg

SEQ ID NO: 68675 - DNA, 20 bp, Artificial Sequence
  sgRNA
  NTC_3928
gtgcactagtggcgtcgacg

SEQ ID NO: 68676 - DNA, 20 bp, Artificial Sequence
  sgRNA
  NTC_3929
tgtctactgtgcgcgataat

SEQ ID NO: 68677 - DNA, 20 bp, Artificial Sequence
  sgRNA
  NTC_3930
cgacactatcggccgcgatc

SEQ ID NO: 68678 - DNA, 20 bp, Artificial Sequence
  sgRNA
  NTC_3931
cgtaacggagatatcgttct

SEQ ID NO: 68679 - DNA, 20 bp, Artificial Sequence
  sgRNA
  NTC_3932
ttcgcgctctacagctcgaa

SEQ ID NO: 68680 - DNA, 20 bp, Artificial Sequence
  sgRNA
  NTC_3933
gactagcggagcattacgag

SEQ ID NO: 68681 - DNA, 20 bp, Artificial Sequence
  sgRNA
  NTC_3934
gaacatcgatctgtcgcgtg

SEQ ID NO: 68682 - DNA, 20 bp, Artificial Sequence
  sgRNA
  NTC_3935
ttggttgcgcgacgattgac

SEQ ID NO: 68683 - DNA, 20 bp, Artificial Sequence
  sgRNA
  NTC_3936
tacttactgtacccgacgcc

SEQ ID NO: 68684 - DNA, 20 bp, Artificial Sequence
  sgRNA
  NTC_3937
cggcgcgttagttgcccgct

SEQ ID NO: 68685 - DNA, 20 bp, Artificial Sequence
  sgRNA
  NTC_3938
tatttgaatgcgcgacgcgc

SEQ ID NO: 68686 - DNA, 20 bp, Artificial Sequence
  sgRNA
  NTC_3939
gagctacggtcgtattccgc

SEQ ID NO: 68687 - DNA, 20 bp, Artificial Sequence
  sgRNA
  NTC_3940
taggtgtcgtacgtcgacct

SEQ ID NO: 68688 - DNA, 20 bp, Artificial Sequence
  sgRNA
  NTC_3941
aatgattcgtcagacgaaca

SEQ ID NO: 68689 - DNA, 20 bp, Artificial Sequence
  sgRNA
  NTC_3942
ggtgggagatcgcgctcctc

SEQ ID NO: 68690 - DNA, 20 bp, Artificial Sequence
  sgRNA
  NTC_3943
actaattcgtctccgtgcgc

SEQ ID NO: 68691 - DNA, 20 bp, Artificial Sequence
  sgRNA
  NTC_3944
tttcgctaactgtgcgcaca

SEQ ID NO: 68692 - DNA, 20 bp, Artificial Sequence
  sgRNA
  NTC_3945
tgctatcgatatccgccgat

SEQ ID NO: 68693 - DNA, 20 bp, Artificial Sequence
  sgRNA
  NTC_3946
aacgtcggcggcccctattg

SEQ ID NO: 68694 - DNA, 20 bp, Artificial Sequence
  sgRNA
  NTC_3947
agatcgcgttaagccgttcg

SEQ ID NO: 68695 - DNA, 20 bp, Artificial Sequence
  sgRNA
  NTC_3948
attcgtagtggccgcgccgc

SEQ ID NO: 68696 - DNA, 20 bp, Artificial Sequence
  sgRNA
  NTC_3949
tacacggatcgctgcgttgc

SEQ ID NO: 68697 - DNA, 20 bp, Artificial Sequence
  sgRNA
  NTC_3950
gcaacttacgaacgctcttc

SEQ ID NO: 68698 - DNA, 20 bp, Artificial Sequence
  sgRNA
  NTC_3951
cgacaggctaacatccgttc

SEQ ID NO: 68699 - DNA, 20 bp, Artificial Sequence
  sgRNA
  NTC_3952
tggtcggaggcgatatcgcg

SEQ ID NO: 68700 - DNA, 20 bp, Artificial Sequence
  sgRNA
  NTC_3953
gggtcgtatatctcgcttgt

SEQ ID NO: 68701 - DNA, 20 bp, Artificial Sequence
  sgRNA
  NTC_3954
tactacgggacttccgcgag

SEQ ID NO: 68702 - DNA, 20 bp, Artificial Sequence
  sgRNA
  NTC_3955
ttgagtcggacgtgcgactc

SEQ ID NO: 68703 - DNA, 20 bp, Artificial Sequence
  sgRNA
  NTC_3956
ggcgtctatcgtacgcaact

SEQ ID NO: 68704 - DNA, 20 bp, Artificial Sequence
  sgRNA
  NTC_3957
tggcttacgggacgcgctag

SEQ ID NO: 68705 - DNA, 20 bp, Artificial Sequence
  sgRNA
  NTC_3958
cgcgcggagtatctcgtcac

SEQ ID NO: 68706 - DNA, 20 bp, Artificial Sequence
  sgRNA
  NTC_3959
tacaacggacgtgcaccgct

SEQ ID NO: 68707 - DNA, 20 bp, Artificial Sequence
  sgRNA
  NTC_3960
tctcgtcgctcgaagtcgcc

SEQ ID NO: 68708 - DNA, 20 bp, Artificial Sequence
  sgRNA
  NTC_3961
ctcgaattggtcgtcgtccc

SEQ ID NO: 68709 - DNA, 20 bp, Artificial Sequence
  sgRNA
  NTC_3962
tatatatcgtcaagcccccg

SEQ ID NO: 68710 - DNA, 20 bp, Artificial Sequence
  sgRNA
  NTC_3963
tacataacgggactacgtcc

SEQ ID NO: 68711 - DNA, 20 bp, Artificial Sequence
  sgRNA
  NTC_3964
tgttaataatcgaacgtgag

SEQ ID NO: 68712 - DNA, 20 bp, Artificial Sequence
  sgRNA
  NTC_3965
cgtgtactcgtccgtagcga

SEQ ID NO: 68713 - DNA, 20 bp, Artificial Sequence
  sgRNA
  NTC_3966
acgttcgtggtactcgatct

SEQ ID NO: 68714 - DNA, 20 bp, Artificial Sequence
  sgRNA
  NTC_3967
ggtttattacgacgattcgc

SEQ ID NO: 68715 - DNA, 20 bp, Artificial Sequence
  sgRNA
  NTC_3968
ctagttcagtatatcgcgag

SEQ ID NO: 68716 - DNA, 20 bp, Artificial Sequence
  sgRNA
  NTC_3969
cgcgcgaggttcacttcgac

SEQ ID NO: 68717 - DNA, 20 bp, Artificial Sequence
  sgRNA
  NTC_3970
cgactagaaagatcgcgcca

SEQ ID NO: 68718 - DNA, 20 bp, Artificial Sequence
  sgRNA
  NTC_3971
tacgcaagtgtcgcgtagtc

SEQ ID NO: 68719 - DNA, 20 bp, Artificial Sequence
  sgRNA
  NTC_3972
tagggtacgctagccgttcg

SEQ ID NO: 68720 - DNA, 20 bp, Artificial Sequence
  sgRNA
  NTC_3973
aagggacgtttcacgcgcga

SEQ ID NO: 68721 - DNA, 20 bp, Artificial Sequence
  sgRNA
  NTC_3974
gcacggaataagcgccgagt

SEQ ID NO: 68722 - DNA, 20 bp, Artificial Sequence
  sgRNA
  NTC_3975
cgagcaatgtactcccgata

SEQ ID NO: 68723 - DNA, 20 bp, Artificial Sequence
  sgRNA
  NTC_3976
attgtgttcgcgcgcaccgc

SEQ ID NO: 68724 - DNA, 20 bp, Artificial Sequence
  sgRNA
  NTC_3977
ttacaacgagcgacgacatc

SEQ ID NO: 68725 - DNA, 20 bp, Artificial Sequence
  sgRNA
  NTC_3978
tttcacgtcgagaacgctat

SEQ ID NO: 68726 - DNA, 20 bp, Artificial Sequence
  sgRNA
  NTC_3979
ggtactggatacacgcgaaa

SEQ ID NO: 68727 - DNA, 20 bp, Artificial Sequence
  sgRNA
  NTC_3980
cgcgagttggaccgatgatc

SEQ ID NO: 68728 - DNA, 20 bp, Artificial Sequence
  sgRNA
  NTC_3981
attcgtcggatcgacgtttg

SEQ ID NO: 68729 - DNA, 20 bp, Artificial Sequence
  sgRNA
  NTC_3982
ggattcgagtagcgcacgac

SEQ ID NO: 68730 - DNA, 20 bp, Artificial Sequence
  sgRNA
  NTC_3983
aatttggcgggtgccgacgc

SEQ ID NO: 68731 - DNA, 20 bp, Artificial Sequence
  sgRNA
  NTC_3984
atgaagttagttcgcgcatt

SEQ ID NO: 68732 - DNA, 20 bp, Artificial Sequence
  sgRNA
  NTC_3985
gagtgcgaataacgcttcac

SEQ ID NO: 68733 - DNA, 20 bp, Artificial Sequence
  sgRNA
  NTC_3986
acgaacggcgacgcgtttcc

SEQ ID NO: 68734 - DNA, 20 bp, Artificial Sequence
  sgRNA
  NTC_3987
acgcgttaatatctccctat

SEQ ID NO: 68735 - DNA, 20 bp, Artificial Sequence
  sgRNA
  NTC_3988
cggatagcgtcatctactaa

SEQ ID NO: 68736 - DNA, 20 bp, Artificial Sequence
  sgRNA
  NTC_3989
gattcactttacgcgcacgc

SEQ ID NO: 68737 - DNA, 20 bp, Artificial Sequence
  sgRNA
  NTC_3990
atcgtaggcggcacgtagat

SEQ ID NO: 68738 - DNA, 20 bp, Artificial Sequence
  sgRNA
  NTC_3991
aagacgacgattacccgtct

SEQ ID NO: 68739 - DNA, 20 bp, Artificial Sequence
  sgRNA
  NTC_3992
gtagtaagttaccccgtacg

SEQ ID NO: 68740 - DNA, 20 bp, Artificial Sequence
  sgRNA
  NTC_3993
ttagtactctacgccgcacg

SEQ ID NO: 68741 - DNA, 20 bp, Artificial Sequence
  sgRNA
  NTC_3994
cgttaggctgtattcgccat

SEQ ID NO: 68742 - DNA, 20 bp, Artificial Sequence
  sgRNA
  NTC_3995
tatctcgacgtcgtttagac

SEQ ID NO: 68743 - DNA, 20 bp, Artificial Sequence
  sgRNA
  NTC_3996
aacgacgttcgtacgttcgc

SEQ ID NO: 68744 - DNA, 20 bp, Artificial Sequence
  sgRNA
  NTC_3997
cgttctgacgtaagtcgcga

SEQ ID NO: 68745 - DNA, 20 bp, Artificial Sequence
  sgRNA
  NTC_3998
atcttagcgcacgactaacg

SEQ ID NO: 68746 - DNA, 20 bp, Artificial Sequence
  sgRNA
  NTC_3999
ggacggcttgacctcgacgt

SEQ ID NO: 68747 - DNA, 20 bp, Artificial Sequence
  sgRNA
  NTC_4000
acggctcttcgccgtttcga

SEQ ID NO: 68748 - DNA, 20 bp, Artificial Sequence
  sgRNA
  NTC_4001
gcgggggcattgtaccagat

SEQ ID NO: 68749 - DNA, 20 bp, Artificial Sequence
  sgRNA
  NTC_4002
tacgcttacaacgtattaga

SEQ ID NO: 68750 - DNA, 20 bp, Artificial Sequence
  sgRNA
  NTC_4003
gcgattggtgcgtatgagcg

SEQ ID NO: 68751 - DNA, 20 bp, Artificial Sequence
  sgRNA
  NTC_4004
cgttggagcgaacgatcgcc

SEQ ID NO: 68752 - DNA, 20 bp, Artificial Sequence
  sgRNA
  NTC_4005
tggacaaaataccgcgtatc

SEQ ID NO: 68753 - DNA, 20 bp, Artificial Sequence
  sgRNA
  NTC_4006
gggttcggctcatccgcgcc

SEQ ID NO: 68754 - DNA, 20 bp, Artificial Sequence
  sgRNA
  NTC_4007
gctcgataatcacgtacaga

SEQ ID NO: 68755 - DNA, 20 bp, Artificial Sequence
  sgRNA
  NTC_4008
agcgcacggggtttccgtta

SEQ ID NO: 68756 - DNA, 20 bp, Artificial Sequence
  sgRNA
  NTC_4009
ggtaaacagtacaacgcgcg

SEQ ID NO: 68757 - DNA, 20 bp, Artificial Sequence
  sgRNA
  NTC_4010
gttcgatcgcgctatgccgt

SEQ ID NO: 68758 - DNA, 20 bp, Artificial Sequence
  sgRNA
  NTC_4011
tacgctaatagaatcgccct

SEQ ID NO: 68759 - DNA, 20 bp, Artificial Sequence
  sgRNA
  NTC_4012
gagattcgggtttgcgccga

SEQ ID NO: 68760 - DNA, 20 bp, Artificial Sequence
  sgRNA
  NTC_4013
taatttaagcggaccccgta

SEQ ID NO: 68761 - DNA, 20 bp, Artificial Sequence
  sgRNA
  NTC_4014
gatggatggctccacgcgcc

SEQ ID NO: 68762 - DNA, 20 bp, Artificial Sequence
  sgRNA
  NTC_4015
acggataggttgttcgcaac

SEQ ID NO: 68763 - DNA, 20 bp, Artificial Sequence
  sgRNA
  NTC_4016
cttggtacggtgcccgactt

SEQ ID NO: 68764 - DNA, 20 bp, Artificial Sequence
  sgRNA
  NTC_4017
cgacgaaaggtctgcgtgat

SEQ ID NO: 68765 - DNA, 20 bp, Artificial Sequence
  sgRNA
  NTC_4018
gcgcggacgatgcgctcgct

SEQ ID NO: 68766 - DNA, 20 bp, Artificial Sequence
  sgRNA
  NTC_4019
cgcgaatctttatccgatgt

SEQ ID NO: 68767 - DNA, 20 bp, Artificial Sequence
  sgRNA
  NTC_4020
tgtagcgcagagtgcgacaa

SEQ ID NO: 68768 - DNA, 20 bp, Artificial Sequence
  sgRNA
  NTC_4021
ggtacgcgacgtttcgcgaa

SEQ ID NO: 68769 - DNA, 20 bp, Artificial Sequence
  sgRNA
  NTC_4022
aataacgggtcgaactacga

SEQ ID NO: 68770 - DNA, 20 bp, Artificial Sequence
  sgRNA
  NTC_4023
tgaacgtgttgcgcccgtcg

SEQ ID NO: 68771 - DNA, 20 bp, Artificial Sequence
  sgRNA
  NTC_4024
tggctattacactgcgttcc

SEQ ID NO: 68772 - DNA, 20 bp, Artificial Sequence
  sgRNA
  NTC_4025
taacaacgaacgcatcgacg

SEQ ID NO: 68773 - DNA, 20 bp, Artificial Sequence
  sgRNA
  NTC_4026
gcgatcgtagggccataagt

SEQ ID NO: 68774 - DNA, 20 bp, Artificial Sequence
  sgRNA
  NTC_4027
cgcgcatagttaaccgtccc

SEQ ID NO: 68775 - DNA, 20 bp, Artificial Sequence
  sgRNA
  NTC_4028
gcgggatagtagttcgtaag

SEQ ID NO: 68776 - DNA, 20 bp, Artificial Sequence
  sgRNA
  NTC_4029
acgaagactgcgcgagtaga

SEQ ID NO: 68777 - DNA, 20 bp, Artificial Sequence
  sgRNA
  NTC_4030
taaacgtcgctgccgcatct

SEQ ID NO: 68778 - DNA, 20 bp, Artificial Sequence
  sgRNA
  NTC_4031
ggcgcgttggacgccatata

SEQ ID NO: 68779 - DNA, 20 bp, Artificial Sequence
  sgRNA
  NTC_4032
tgttacgtgatgagcgtaag

SEQ ID NO: 68780 - DNA, 20 bp, Artificial Sequence
  sgRNA
  NTC_4033
catgacgcgcaacgtatccg

SEQ ID NO: 68781 - DNA, 20 bp, Artificial Sequence
  sgRNA
  NTC_4034
gaggtatcatcgatcccgtt

SEQ ID NO: 68782 - DNA, 20 bp, Artificial Sequence
  sgRNA
  NTC_4035
gatgcgcgattgcctgaccg

SEQ ID NO: 68783 - DNA, 20 bp, Artificial Sequence
  sgRNA
  NTC_4036
ggtgtcgagacgagacgaac

SEQ ID NO: 68784 - DNA, 20 bp, Artificial Sequence
  sgRNA
  NTC_4037
ggcgcatcggtaccaacccg

SEQ ID NO: 68785 - DNA, 20 bp, Artificial Sequence
  sgRNA
  NTC_4038
ataattgatgctccgtcgct

SEQ ID NO: 68786 - DNA, 20 bp, Artificial Sequence
  sgRNA
  NTC_4039
taagacgcgtatacgatcac

SEQ ID NO: 68787 - DNA, 20 bp, Artificial Sequence
  sgRNA
  NTC_4040
ctatatgggtcgcgtatgac

SEQ ID NO: 68788 - DNA, 20 bp, Artificial Sequence
  sgRNA
  NTC_4041
tgcatactattcgtacgtcg

SEQ ID NO: 68789 - DNA, 20 bp, Artificial Sequence
  sgRNA
  NTC_4042
tcgggttcgtagcagacgta

SEQ ID NO: 68790 - DNA, 20 bp, Artificial Sequence
  sgRNA
  NTC_4043
acgaatcatcggagcgaccg

SEQ ID NO: 68791 - DNA, 20 bp, Artificial Sequence
  sgRNA
  NTC_4044
gacgacggaattcatgccgc

SEQ ID NO: 68792 - DNA, 20 bp, Artificial Sequence
  sgRNA
  NTC_4045
cggtatcatttcgataccca

SEQ ID NO: 68793 - DNA, 20 bp, Artificial Sequence
  sgRNA
  NTC_4046
ttacgcatggggatacgcct

SEQ ID NO: 68794 - DNA, 20 bp, Artificial Sequence
  sgRNA
  NTC_4047
cgcgttatacggtgcagtag

SEQ ID NO: 68795 - DNA, 20 bp, Artificial Sequence
  sgRNA
  NTC_4048
atgcgttcgtcgccagatca

SEQ ID NO: 68796 - DNA, 20 bp, Artificial Sequence
  sgRNA
  NTC_4049
ctcttatgcagcgtcgccta

SEQ ID NO: 68797 - DNA, 20 bp, Artificial Sequence
  sgRNA
  NTC_4050
cggagtaaggcgacccgttc

SEQ ID NO: 68798 - DNA, 20 bp, Artificial Sequence
  sgRNA
  NTC_4051
ttgcgatacgtgcgtactcg

SEQ ID NO: 68799 - DNA, 20 bp, Artificial Sequence
  sgRNA
  NTC_4052
tgttcgcgtagataccgttc

SEQ ID NO: 68800 - DNA, 20 bp, Artificial Sequence
  sgRNA
  NTC_4053
cagcgcactcgcgccgagta

SEQ ID NO: 68801 - DNA, 20 bp, Artificial Sequence
  sgRNA
  NTC_4054
cggacgtggttgcacgctag

SEQ ID NO: 68802 - DNA, 20 bp, Artificial Sequence
  sgRNA
  NTC_4055
tacgacattgcgcgctcgac

SEQ ID NO: 68803 - DNA, 20 bp, Artificial Sequence
  sgRNA
  NTC_4056
aggtattgcattccgcgcca

SEQ ID NO: 68804 - DNA, 20 bp, Artificial Sequence
  sgRNA
  NTC_4057
gctgcgcgattacgctagcg

SEQ ID NO: 68805 - DNA, 20 bp, Artificial Sequence
  sgRNA
  NTC_4058
tacgtaacacgagacgatag

SEQ ID NO: 68806 - DNA, 20 bp, Artificial Sequence
  sgRNA
  NTC_4059
aggttactcgtcgtaccacg

SEQ ID NO: 68807 - DNA, 20 bp, Artificial Sequence
  sgRNA
  NTC_4060
tcgacgtaatatatcgttac

SEQ ID NO: 68808 - DNA, 20 bp, Artificial Sequence
  sgRNA
  NTC_4061
caactcataacgaacgtcat

SEQ ID NO: 68809 - DNA, 20 bp, Artificial Sequence
  sgRNA
  NTC_4062
agagtcacttggcgccttcg

SEQ ID NO: 68810 - DNA, 20 bp, Artificial Sequence
  sgRNA
  NTC_4063
gtacatcgtgggcgacgcat

SEQ ID NO: 68811 - DNA, 20 bp, Artificial Sequence
  sgRNA
  NTC_4064
tggtagtgcgcgttacattg

SEQ ID NO: 68812 - DNA, 20 bp, Artificial Sequence
  sgRNA
  NTC_4065
tcactgcaacgtcgtaagtt

SEQ ID NO: 68813 - DNA, 20 bp, Artificial Sequence
  sgRNA
  NTC_4066
atattcacgcaccgcgtcat

SEQ ID NO: 68814 - DNA, 20 bp, Artificial Sequence
  sgRNA
  NTC_4067
acggcatcgtgcgcctacat

SEQ ID NO: 68815 - DNA, 20 bp, Artificial Sequence
  sgRNA
  NTC_4068
gcgatgttcgacgatactta

SEQ ID NO: 68816 - DNA, 20 bp, Artificial Sequence
  sgRNA
  NTC_4069
tcgtggagagtcagctacga

SEQ ID NO: 68817 - DNA, 20 bp, Artificial Sequence
  sgRNA
  NTC_4070
atagcataatctcacgacgc

SEQ ID NO: 68818 - DNA, 20 bp, Artificial Sequence
  sgRNA
  NTC_4071
tctcggtatgcgccctgatc

SEQ ID NO: 68819 - DNA, 20 bp, Artificial Sequence
  sgRNA
  NTC_4072
atgcgggcatcatacgtacg

SEQ ID NO: 68820 - DNA, 20 bp, Artificial Sequence
  sgRNA
  NTC_4073
gcacgtcgatcgcatatgag

SEQ ID NO: 68821 - DNA, 20 bp, Artificial Sequence
  sgRNA
  NTC_4074
catcgcatgcacctgcgacg

SEQ ID NO: 68822 - DNA, 20 bp, Artificial Sequence
  sgRNA
  NTC_4075
ggatcgcgcacgcagaaacg

SEQ ID NO: 68823 - DNA, 20 bp, Artificial Sequence
  sgRNA
  NTC_4076
gtcggtgcgttctatattag

SEQ ID NO: 68824 - DNA, 20 bp, Artificial Sequence
  sgRNA
  NTC_4077
taagaacagcgcgacgatcg

SEQ ID NO: 68825 - DNA, 20 bp, Artificial Sequence
  sgRNA
  NTC_4078
gcgcgtttcgacacgcgccc

SEQ ID NO: 68826 - DNA, 20 bp, Artificial Sequence
  sgRNA
  NTC_4079
tcgcgtttatcgctatatgc

SEQ ID NO: 68827 - DNA, 20 bp, Artificial Sequence
  sgRNA
  NTC_4080
cgcgcaaaacgtccgccatc

SEQ ID NO: 68828 - DNA, 20 bp, Artificial Sequence
  sgRNA
  NTC_4081
cgaattacgatcgctccagt

SEQ ID NO: 68829 - DNA, 20 bp, Artificial Sequence
  sgRNA
  NTC_4082
cgcagctagacgcgatgtgt

SEQ ID NO: 68830 - DNA, 20 bp, Artificial Sequence
  sgRNA
  NTC_4083
ggacgcaggatatcgtcgac

SEQ ID NO: 68831 - DNA, 20 bp, Artificial Sequence
  sgRNA
  NTC_4084
tcgaaaactttatcgcaata

SEQ ID NO: 68832 - DNA, 20 bp, Artificial Sequence
  sgRNA
  NTC_4085
ttgcactcaattcgcgacca

SEQ ID NO: 68833 - DNA, 20 bp, Artificial Sequence
  sgRNA
  NTC_4086
aaggtcaagagctgcgtcgt

SEQ ID NO: 68834 - DNA, 20 bp, Artificial Sequence
  sgRNA
  NTC_4087
taacgcgacaggagtcgtag

SEQ ID NO: 68835 - DNA, 20 bp, Artificial Sequence
  sgRNA
  NTC_4088
ggttcgctacgtacgccact

SEQ ID NO: 68836 - DNA, 20 bp, Artificial Sequence
  sgRNA
  NTC_4089
gtaggcggtgatgcccgttc

SEQ ID NO: 68837 - DNA, 20 bp, Artificial Sequence
  sgRNA
  NTC_4090
cttgtgcgatcttcgatcga

SEQ ID NO: 68838 - DNA, 20 bp, Artificial Sequence
  sgRNA
  NTC_4091
gcgcgcgtatacaaattgcg

SEQ ID NO: 68839 - DNA, 20 bp, Artificial Sequence
  sgRNA
  NTC_4092
ggaaagctaagcgcccacgc

SEQ ID NO: 68840 - DNA, 20 bp, Artificial Sequence
  sgRNA
  NTC_4093
gcagagcgtgcgatcgtcag

SEQ ID NO: 68841 - DNA, 20 bp, Artificial Sequence
  sgRNA
  NTC_4094
ggcgacagttcaacgaaccg

SEQ ID NO: 68842 - DNA, 20 bp, Artificial Sequence
  sgRNA
  NTC_4095
ttactacatgactcgtaccg

SEQ ID NO: 68843 - DNA, 20 bp, Artificial Sequence
  sgRNA
  NTC_4096
tgcacgattggcgcactaat

SEQ ID NO: 68844 - DNA, 20 bp, Artificial Sequence
  sgRNA
  NTC_4097
caagcattcgctcgcgagat

SEQ ID NO: 68845 - DNA, 20 bp, Artificial Sequence
  sgRNA
  NTC_4098
tgtttcggcttgcgcacctc

SEQ ID NO: 68846 - DNA, 20 bp, Artificial Sequence
  sgRNA
  NTC_4099
tcactcggcttcgcatcgcg

SEQ ID NO: 68847 - DNA, 20 bp, Artificial Sequence
  sgRNA
  NTC_4100
gatcgaacgctagtccaaaa

SEQ ID NO: 68848 - DNA, 20 bp, Artificial Sequence
  sgRNA
  NTC_4101
gtcgttcgtataatccgtgc

SEQ ID NO: 68849 - DNA, 20 bp, Artificial Sequence
  sgRNA
  NTC_4102
caggcgtaagtttgcgcact

SEQ ID NO: 68850 - DNA, 20 bp, Artificial Sequence
  sgRNA
  NTC_4103
gttcgcggagtccgacctcc

SEQ ID NO: 68851 - DNA, 20 bp, Artificial Sequence
  sgRNA
  NTC_4104
tgaatatctgaccgcccacg

SEQ ID NO: 68852 - DNA, 20 bp, Artificial Sequence
  sgRNA
  NTC_4105
acatgtgcatcgatccagcg

SEQ ID NO: 68853 - DNA, 20 bp, Artificial Sequence
  sgRNA
  NTC_4106
acgacgcgggcgtttcgttc

SEQ ID NO: 68854 - DNA, 20 bp, Artificial Sequence
  sgRNA
  NTC_4107
ttgtgtagcacgagtacgac

SEQ ID NO: 68855 - DNA, 20 bp, Artificial Sequence
  sgRNA
  NTC_4108
ggacttgcaacgattactta

SEQ ID NO: 68856 - DNA, 20 bp, Artificial Sequence
  sgRNA
  NTC_4109
ggagatctgtcgagtcgtac

SEQ ID NO: 68857 - DNA, 20 bp, Artificial Sequence
  sgRNA
  NTC_4110
cggcattacgtgttgccgcg

SEQ ID NO: 68858 - DNA, 20 bp, Artificial Sequence
  sgRNA
  NTC_4111
aggcgaactcggcgtcgtca

SEQ ID NO: 68859 - DNA, 20 bp, Artificial Sequence
  sgRNA
  NTC_4112
caaaacggcaatttcgcgtg

SEQ ID NO: 68860 - DNA, 20 bp, Artificial Sequence
  sgRNA
  NTC_4113
cgcgctacatgcaatagtcg

SEQ ID NO: 68861 - DNA, 20 bp, Artificial Sequence
  sgRNA
  NTC_4114
acgtcgatctgtcgtgatcg

SEQ ID NO: 68862 - DNA, 20 bp, Artificial Sequence
  sgRNA
  NTC_4115
tatcgtcacaacctaccgta

SEQ ID NO: 68863 - DNA, 20 bp, Artificial Sequence
  sgRNA
  NTC_4116
gatgattggactacgccatc

SEQ ID NO: 68864 - DNA, 20 bp, Artificial Sequence
  sgRNA
  NTC_4117
ttataattcggctccgttta

SEQ ID NO: 68865 - DNA, 20 bp, Artificial Sequence
  sgRNA
  NTC_4118
ttcgcagcggaacgctagtg

SEQ ID NO: 68866 - DNA, 20 bp, Artificial Sequence
  sgRNA
  NTC_4119
tcgcgaattgctcgccccta

SEQ ID NO: 68867 - DNA, 20 bp, Artificial Sequence
  sgRNA
  NTC_4120
cgacgctaatttgccgagtg

SEQ ID NO: 68868 - DNA, 20 bp, Artificial Sequence
  sgRNA
  NTC_4121
aggttgggattaagccgcgt

SEQ ID NO: 68869 - DNA, 20 bp, Artificial Sequence
  sgRNA
  NTC_4122
gacttgcgtcagcgatttca

SEQ ID NO: 68870 - DNA, 20 bp, Artificial Sequence
  sgRNA
  NTC_4123
tgggttacgcggattcgtaa

SEQ ID NO: 68871 - DNA, 20 bp, Artificial Sequence
  sgRNA
  NTC_4124
gtgaacgcgaggttccgtct

SEQ ID NO: 68872 - DNA, 20 bp, Artificial Sequence
  sgRNA
  NTC_4125
gagcacgggttcgtcgcgaa

SEQ ID NO: 68873 - DNA, 20 bp, Artificial Sequence
  sgRNA
  NTC_4126
cggtttagcaattacgagcg

SEQ ID NO: 68874 - DNA, 20 bp, Artificial Sequence
  sgRNA
  NTC_4127
tcgctacgacggcctcttat

SEQ ID NO: 68875 - DNA, 20 bp, Artificial Sequence
  sgRNA
  NTC_4128
tgacgtgatttaacgaccga

SEQ ID NO: 68876 - DNA, 20 bp, Artificial Sequence
  sgRNA
  NTC_4129
cggacgaggtatctaagcgc

SEQ ID NO: 68877 - DNA, 20 bp, Artificial Sequence
  sgRNA
  NTC_4130
tattacgcgtctacgcgcta

SEQ ID NO: 68878 - DNA, 20 bp, Artificial Sequence
  sgRNA
  NTC_4131
tgcgtgttgtcgaccgaaga

SEQ ID NO: 68879 - DNA, 20 bp, Artificial Sequence
  sgRNA
  NTC_4132
attgattggcggtacacgat

SEQ ID NO: 68880 - DNA, 20 bp, Artificial Sequence
  sgRNA
  NTC_4133
agggcgcggaacaactagtc

SEQ ID NO: 68881 - DNA, 20 bp, Artificial Sequence
  sgRNA
  NTC_4134
ttggtcaggtttcgcgcatc

SEQ ID NO: 68882 - DNA, 20 bp, Artificial Sequence
  sgRNA
  NTC_4135
tgtacgacactgataatccg

SEQ ID NO: 68883 - DNA, 20 bp, Artificial Sequence
  sgRNA
  NTC_4136
atcgtcgtaacagatatgcg

SEQ ID NO: 68884 - DNA, 20 bp, Artificial Sequence
  sgRNA
  NTC_4137
caagcgcgagcgtcgcccga

SEQ ID NO: 68885 - DNA, 20 bp, Artificial Sequence
  sgRNA
  NTC_4138
gtcgattcgagcgcaacgca

SEQ ID NO: 68886 - DNA, 20 bp, Artificial Sequence
  sgRNA
  NTC_4139
cgagggatcatcgcgcttta

SEQ ID NO: 68887 - DNA, 20 bp, Artificial Sequence
  sgRNA
  NTC_4140
cttcgaaactgacccgtcca

SEQ ID NO: 68888 - DNA, 20 bp, Artificial Sequence
  sgRNA
  NTC_4141
gcttaacgagtagtgccgtt

SEQ ID NO: 68889 - DNA, 20 bp, Artificial Sequence
  sgRNA
  NTC_4142
aacggtcgtcaaatccgtcg

SEQ ID NO: 68890 - DNA, 20 bp, Artificial Sequence
  sgRNA
  NTC_4143
ggacgcgtttgttacgcgcc

SEQ ID NO: 68891 - DNA, 20 bp, Artificial Sequence
  sgRNA
  NTC_4144
gtagagcgcatcaacgatta

SEQ ID NO: 68892 - DNA, 20 bp, Artificial Sequence
  sgRNA
  NTC_4145
taactgcgcggtacgagtat

SEQ ID NO: 68893 - DNA, 20 bp, Artificial Sequence
  sgRNA
  NTC_4146
ggaatgtgggtccgaatcga

SEQ ID NO: 68894 - DNA, 20 bp, Artificial Sequence
  sgRNA
  NTC_4147
gtgagcggaatcgacgaaat

SEQ ID NO: 68895 - DNA, 20 bp, Artificial Sequence
  sgRNA
  NTC_4148
aggttacgcgggatgcgacg

SEQ ID NO: 68896 - DNA, 20 bp, Artificial Sequence
  sgRNA
  NTC_4149
agacgatgggcgtcgcaaag

SEQ ID NO: 68897 - DNA, 20 bp, Artificial Sequence
  sgRNA
  NTC_4150
cgatcacataactgcgagca

SEQ ID NO: 68898 - DNA, 20 bp, Artificial Sequence
  sgRNA
  NTC_4151
acgggcggagaagcgacgtt

SEQ ID NO: 68899 - DNA, 20 bp, Artificial Sequence
  sgRNA
  NTC_4152
tgtactgttgacgatcgtcg

SEQ ID NO: 68900 - DNA, 20 bp, Artificial Sequence
  sgRNA
  NTC_4153
agtacgcgcggccactcgta

SEQ ID NO: 68901 - DNA, 20 bp, Artificial Sequence
  sgRNA
  NTC_4154
gtttcgataaggtcgacgtc

SEQ ID NO: 68902 - DNA, 20 bp, Artificial Sequence
  sgRNA
  NTC_4155
gtatagcgacgacgacgagt

SEQ ID NO: 68903 - DNA, 20 bp, Artificial Sequence
  sgRNA
  NTC_4156
taactgacgtgaaccagtcg

SEQ ID NO: 68904 - DNA, 20 bp, Artificial Sequence
  sgRNA
  NTC_4157
ggcttctcgtgcctcgagcg

SEQ ID NO: 68905 - DNA, 20 bp, Artificial Sequence
  sgRNA
  NTC_4158
ggtttaacgagcaacgtacc

SEQ ID NO: 68906 - DNA, 20 bp, Artificial Sequence
  sgRNA
  NTC_4159
agttcgcatggattccgcgt

SEQ ID NO: 68907 - DNA, 20 bp, Artificial Sequence
  sgRNA
  NTC_4160
tacgataaggcgcaagccgt

SEQ ID NO: 68908 - DNA, 20 bp, Artificial Sequence
  sgRNA
  NTC_4161
ggtaaggtcgaatcgtcata

SEQ ID NO: 68909 - DNA, 20 bp, Artificial Sequence
  sgRNA
  NTC_4162
cagttcggtgtcaacgaacg

SEQ ID NO: 68910 - DNA, 20 bp, Artificial Sequence
  sgRNA
  NTC_4163
cggtttagcgataatacgta

SEQ ID NO: 68911 - DNA, 20 bp, Artificial Sequence
  sgRNA
  NTC_4164
cgtattcgcgaacctccgat

SEQ ID NO: 68912 - DNA, 20 bp, Artificial Sequence
  sgRNA
  NTC_4165
cgttctcaacggatcagtcg

SEQ ID NO: 68913 - DNA, 20 bp, Artificial Sequence
  sgRNA
  NTC_4166
attaggtgctgccgctcgat

SEQ ID NO: 68914 - DNA, 20 bp, Artificial Sequence
  sgRNA
  NTC_4167
gcgagtcgtcgttcccgact

SEQ ID NO: 68915 - DNA, 20 bp, Artificial Sequence
  sgRNA
  NTC_4168
gcgacgtaggtgaacacgag

SEQ ID NO: 68916 - DNA, 20 bp, Artificial Sequence
  sgRNA
  NTC_4169
gcgatgtatacgtcccatga

SEQ ID NO: 68917 - DNA, 20 bp, Artificial Sequence
  sgRNA
  NTC_4170
gcatgtcgctcgaacgagct

SEQ ID NO: 68918 - DNA, 20 bp, Artificial Sequence
  sgRNA
  NTC_4171
gtttggtaacgcgtcgtctc

SEQ ID NO: 68919 - DNA, 20 bp, Artificial Sequence
  sgRNA
  NTC_4172
atcgcgatctacgatgaaga

SEQ ID NO: 68920 - DNA, 20 bp, Artificial Sequence
  sgRNA
  NTC_4173
ttgaatctattcgacgcgac

SEQ ID NO: 68921 - DNA, 20 bp, Artificial Sequence
  sgRNA
  NTC_4174
gtgttcgcgaggcccattat

SEQ ID NO: 68922 - DNA, 20 bp, Artificial Sequence
  sgRNA
  NTC_4175
cgtcttctacgaccaactag

SEQ ID NO: 68923 - DNA, 20 bp, Artificial Sequence
  sgRNA
  NTC_4176
ggttatacggagcgttaatt

SEQ ID NO: 68924 - DNA, 20 bp, Artificial Sequence
  sgRNA
  NTC_4177
ctaagtcgctagacgtcact

SEQ ID NO: 68925 - DNA, 20 bp, Artificial Sequence
  sgRNA
  NTC_4178
cggcagagcgatccgaaatc

SEQ ID NO: 68926 - DNA, 20 bp, Artificial Sequence
  sgRNA
  NTC_4179
aaatagcgtacgaacgagac

SEQ ID NO: 68927 - DNA, 20 bp, Artificial Sequence
  sgRNA
  NTC_4180
gatcgaagtatgccctcgtt

SEQ ID NO: 68928 - DNA, 20 bp, Artificial Sequence
  sgRNA
  NTC_4181
ctaaattcgggcaaccgtat

SEQ ID NO: 68929 - DNA, 20 bp, Artificial Sequence
  sgRNA
  NTC_4182
catacgtcatttgcgacgtc

SEQ ID NO: 68930 - DNA, 20 bp, Artificial Sequence
  sgRNA
  NTC_4183
atgaacgtgcgttgcgctac

SEQ ID NO: 68931 - DNA, 20 bp, Artificial Sequence
  sgRNA
  NTC_4184
tgggcgcaagcgcgtaccaa

SEQ ID NO: 68932 - DNA, 20 bp, Artificial Sequence
  sgRNA
  NTC_4185
ttagcaaaatatcgacgctc

SEQ ID NO: 68933 - DNA, 20 bp, Artificial Sequence
  sgRNA
  NTC_4186
ctggagcggtactctgtacg

SEQ ID NO: 68934 - DNA, 20 bp, Artificial Sequence
  sgRNA
  NTC_4187
gttgcactcaacgtcatata

SEQ ID NO: 68935 - DNA, 20 bp, Artificial Sequence
  sgRNA
  NTC_4188
tcgcggtgttcacgtcaaca

SEQ ID NO: 68936 - DNA, 20 bp, Artificial Sequence
  sgRNA
  NTC_4189
atataactttgccgcgagta

SEQ ID NO: 68937 - DNA, 20 bp, Artificial Sequence
  sgRNA
  NTC_4190
tcgactaacgacgcccaata

SEQ ID NO: 68938 - DNA, 20 bp, Artificial Sequence
  sgRNA
  NTC_4191
ggcgatacgatgagtcgtgt

SEQ ID NO: 68939 - DNA, 20 bp, Artificial Sequence
  sgRNA
  NTC_4192
cgtaaatcatcgcgcttacg

SEQ ID NO: 68940 - DNA, 20 bp, Artificial Sequence
  sgRNA
  NTC_4193
tttactaatcgacccgttcc

SEQ ID NO: 68941 - DNA, 20 bp, Artificial Sequence
  sgRNA
  NTC_4194
ttgaaggcgtcagccgacca

SEQ ID NO: 68942 - DNA, 20 bp, Artificial Sequence
  sgRNA
  NTC_4195
cgtaatgtgttccccgttac

SEQ ID NO: 68943 - DNA, 20 bp, Artificial Sequence
  sgRNA
  NTC_4196
actacagcgtgccacgaact

SEQ ID NO: 68944 - DNA, 20 bp, Artificial Sequence
  sgRNA
  NTC_4197
ggttcatgtgttgcgtcgag

SEQ ID NO: 68945 - DNA, 20 bp, Artificial Sequence
  sgRNA
  NTC_4198
gagtgtaagtagtccgcctt

SEQ ID NO: 68946 - DNA, 20 bp, Artificial Sequence
  sgRNA
  NTC_4199
tcgctagaggtcatacgctc

SEQ ID NO: 68947 - DNA, 20 bp, Artificial Sequence
  sgRNA
  NTC_4200
tatgttacgcgagtctaccc

SEQ ID NO: 68948 - DNA, 20 bp, Artificial Sequence
  sgRNA
  NTC_4201
gcaagctactggacctcgat

SEQ ID NO: 68949 - DNA, 20 bp, Artificial Sequence
  sgRNA
  NTC_4202
gcgcacggtcacataatcgt

SEQ ID NO: 68950 - DNA, 20 bp, Artificial Sequence
  sgRNA
  NTC_4203
ctaagcgtataatgacgatc

SEQ ID NO: 68951 - DNA, 20 bp, Artificial Sequence
  sgRNA
  NTC_4204
atactgcgtgcgatacgctt

SEQ ID NO: 68952 - DNA, 20 bp, Artificial Sequence
  sgRNA
  NTC_4205
gcgaacgtactagttatccc

SEQ ID NO: 68953 - DNA, 20 bp, Artificial Sequence
  sgRNA
  NTC_4206
gttactcgattcgcacgcca

SEQ ID NO: 68954 - DNA, 20 bp, Artificial Sequence
  sgRNA
  NTC_4207
tcacgttgcgaacgcgatgc

SEQ ID NO: 68955 - DNA, 20 bp, Artificial Sequence
  sgRNA
  NTC_4208
ggcggaacttaacaaacccg

SEQ ID NO: 68956 - DNA, 20 bp, Artificial Sequence
  sgRNA
  NTC_4209
gatttacttcgacccctcga

SEQ ID NO: 68957 - DNA, 20 bp, Artificial Sequence
  sgRNA
  NTC_4210
gacgttcttggcgcccaacg

SEQ ID NO: 68958 - DNA, 20 bp, Artificial Sequence
  sgRNA
  NTC_4211
gtatacacgtcaaatcgccc

SEQ ID NO: 68959 - DNA, 20 bp, Artificial Sequence
  sgRNA
  NTC_4212
gcgggctcgatttacgacac

SEQ ID NO: 68960 - DNA, 20 bp, Artificial Sequence
  sgRNA
  NTC_4213
atgtagttagggcgcgattt

SEQ ID NO: 68961 - DNA, 20 bp, Artificial Sequence
  sgRNA
  NTC_4214
taacgctcgcgcatacgtag

SEQ ID NO: 68962 - DNA, 20 bp, Artificial Sequence
  sgRNA
  NTC_4215
gtgtggagctaccccgcgcg

SEQ ID NO: 68963 - DNA, 20 bp, Artificial Sequence
  sgRNA
  NTC_4216
gcgtgactagtgctcgcttc

SEQ ID NO: 68964 - DNA, 20 bp, Artificial Sequence
  sgRNA
  NTC_4217
gttagtcgactagccacccg

SEQ ID NO: 68965 - DNA, 20 bp, Artificial Sequence
  sgRNA
  NTC_4218
tctcgggggttcgcgaccag

SEQ ID NO: 68966 - DNA, 20 bp, Artificial Sequence
  sgRNA
  NTC_4219
cttctacgggcgcgcgcttg

SEQ ID NO: 68967 - DNA, 20 bp, Artificial Sequence
  sgRNA
  NTC_4220
atatctggttgcgtccgccc

SEQ ID NO: 68968 - DNA, 20 bp, Artificial Sequence
  sgRNA
  NTC_4221
cttcgggcagcgcgcctaat

SEQ ID NO: 68969 - DNA, 20 bp, Artificial Sequence
  sgRNA
  NTC_4222
tcgacggactcagcccgacg

SEQ ID NO: 68970 - DNA, 20 bp, Artificial Sequence
  sgRNA
  NTC_4223
gcggatctgcgcgtcgtgat

SEQ ID NO: 68971 - DNA, 20 bp, Artificial Sequence
  sgRNA
  NTC_4224
cgcactcgaaaacgcgcata

SEQ ID NO: 68972 - DNA, 20 bp, Artificial Sequence
  sgRNA
  NTC_4225
tcggtttaagtgcgcgatgt

SEQ ID NO: 68973 - DNA, 20 bp, Artificial Sequence
  sgRNA
  NTC_4226
ctaacacggttacccgaacc

SEQ ID NO: 68974 - DNA, 20 bp, Artificial Sequence
  sgRNA
  NTC_4227
cgcgattaaggatcgtccag

SEQ ID NO: 68975 - DNA, 20 bp, Artificial Sequence
  sgRNA
  NTC_4228
agaacgtcgaagaatcgtcc

SEQ ID NO: 68976 - DNA, 20 bp, Artificial Sequence
  sgRNA
  NTC_4229
agatgatgtactcgccgcgt

SEQ ID NO: 68977 - DNA, 20 bp, Artificial Sequence
  sgRNA
  NTC_4230
aagtctacggtgcaccgttc

SEQ ID NO: 68978 - DNA, 20 bp, Artificial Sequence
  sgRNA
  NTC_4231
catatgacggcacgtttagt

SEQ ID NO: 68979 - DNA, 20 bp, Artificial Sequence
  sgRNA
  NTC_4232
tcgatagtcgctttgacgtt

SEQ ID NO: 68980 - DNA, 20 bp, Artificial Sequence
  sgRNA
  NTC_4233
tgggtcacgtcgcgaagacg

SEQ ID NO: 68981 - DNA, 20 bp, Artificial Sequence
  sgRNA
  NTC_4234
catacgacatgtgccacatt

SEQ ID NO: 68982 - DNA, 20 bp, Artificial Sequence
  sgRNA
  NTC_4235
ctgcgcttatagacgacgac

SEQ ID NO: 68983 - DNA, 20 bp, Artificial Sequence
  sgRNA
  NTC_4236
cgatggaggtacatcgaacg

SEQ ID NO: 68984 - DNA, 20 bp, Artificial Sequence
  sgRNA
  NTC_4237
acgatcacgtatacccgata

SEQ ID NO: 68985 - DNA, 20 bp, Artificial Sequence
  sgRNA
  NTC_4238
ctgcggttcaaacgacccga

SEQ ID NO: 68986 - DNA, 20 bp, Artificial Sequence
  sgRNA
  NTC_4239
gtaatatacagacgcgccgt

SEQ ID NO: 68987 - DNA, 20 bp, Artificial Sequence
  sgRNA
  NTC_4240
attggacgtggagtcgacta

SEQ ID NO: 68988 - DNA, 20 bp, Artificial Sequence
  sgRNA
  NTC_4241
gaggtgctcgattgtaccga

SEQ ID NO: 68989 - DNA, 20 bp, Artificial Sequence
  sgRNA
  NTC_4242
ttagcgtcgtcgtcgttagt

SEQ ID NO: 68990 - DNA, 20 bp, Artificial Sequence
  sgRNA
  NTC_4243
actatgctaaatcgtaacgt

SEQ ID NO: 68991 - DNA, 20 bp, Artificial Sequence
  sgRNA
  NTC_4244
acgtgaaatcgatgcgacgc

SEQ ID NO: 68992 - DNA, 20 bp, Artificial Sequence
  sgRNA
  NTC_4245
agtctcgattggaacgcatc

SEQ ID NO: 68993 - DNA, 20 bp, Artificial Sequence
  sgRNA
  NTC_4246
ctgaagtgttcgacgcatat

SEQ ID NO: 68994 - DNA, 20 bp, Artificial Sequence
  sgRNA
  NTC_4247
ggactacgattcgcattatc

SEQ ID NO: 68995 - DNA, 20 bp, Artificial Sequence
  sgRNA
  NTC_4248
ttctaaacgaatagcaccgc

SEQ ID NO: 68996 - DNA, 20 bp, Artificial Sequence
  sgRNA
  NTC_4249
tcgaggtggtcgcactcgaa

SEQ ID NO: 68997 - DNA, 20 bp, Artificial Sequence
  sgRNA
  NTC_4250
cgtgagcgcataaccgtgcc

SEQ ID NO: 68998 - DNA, 20 bp, Artificial Sequence
  sgRNA
  NTC_4251
ggtttgagttcgacgcgact

SEQ ID NO: 68999 - DNA, 20 bp, Artificial Sequence
  sgRNA
  NTC_4252
gcgctcgtactatcccgtcg

SEQ ID NO: 69000 - DNA, 20 bp, Artificial Sequence
  sgRNA
  NTC_4253
gctcgcgctttactccgaat

SEQ ID NO: 69001 - DNA, 20 bp, Artificial Sequence
  sgRNA
  NTC_4254
gtcgtctagttccgcccgtc

SEQ ID NO: 69002 - DNA, 20 bp, Artificial Sequence
  sgRNA
  NTC_4255
actcgtcaagctcttcgcgc

SEQ ID NO: 69003 - DNA, 20 bp, Artificial Sequence
  sgRNA
  NTC_4256
agtttggggtcgatcgacta

SEQ ID NO: 69004 - DNA, 20 bp, Artificial Sequence
  sgRNA
  NTC_4257
atgtcgcgacgtactccgta

SEQ ID NO: 69005 - DNA, 20 bp, Artificial Sequence
  sgRNA
  NTC_4258
gttcggagattacccgacga

SEQ ID NO: 69006 - DNA, 20 bp, Artificial Sequence
  sgRNA
  NTC_4259
tgaggcagtacgtcgtactt

SEQ ID NO: 69007 - DNA, 20 bp, Artificial Sequence
  sgRNA
  NTC_4260
ttaggcgcatatcgttcaac

SEQ ID NO: 69008 - DNA, 20 bp, Artificial Sequence
  sgRNA
  NTC_4261
gtaacgatctcgttccgcgt

SEQ ID NO: 69009 - DNA, 20 bp, Artificial Sequence
  sgRNA
  NTC_4262
agtggtgttcggcgtattcc

SEQ ID NO: 69010 - DNA, 20 bp, Artificial Sequence
  sgRNA
  NTC_4263
aactacggcgaccgtcacgt

SEQ ID NO: 69011 - DNA, 20 bp, Artificial Sequence
  sgRNA
  NTC_4264
agcgcatacgcgtacgtaat

SEQ ID NO: 69012 - DNA, 20 bp, Artificial Sequence
  sgRNA
  NTC_4265
gtcttagtcacatcgactcg

SEQ ID NO: 69013 - DNA, 20 bp, Artificial Sequence
  sgRNA
  NTC_4266
acgcggtgaactaccgcatt

SEQ ID NO: 69014 - DNA, 20 bp, Artificial Sequence
  sgRNA
  NTC_4267
gtcgaacgtctgctaataat

SEQ ID NO: 69015 - DNA, 20 bp, Artificial Sequence
  sgRNA
  NTC_4268
cacattgtatagcgcgagta

SEQ ID NO: 69016 - DNA, 20 bp, Artificial Sequence
  sgRNA
  NTC_4269
gagagtctatcgtaccgttc

SEQ ID NO: 69017 - DNA, 20 bp, Artificial Sequence
  sgRNA
  NTC_4270
ttcgaattcacgcaatacgc

SEQ ID NO: 69018 - DNA, 20 bp, Artificial Sequence
  sgRNA
  NTC_4271
gtatgttgtcgactcgcatg

SEQ ID NO: 69019 - DNA, 20 bp, Artificial Sequence
  sgRNA
  NTC_4272
actgtcagctatcgccgtcg

SEQ ID NO: 69020 - DNA, 20 bp, Artificial Sequence
  sgRNA
  NTC_4273
tcgtacggcgcatgcactta

SEQ ID NO: 69021 - DNA, 20 bp, Artificial Sequence
  sgRNA
  NTC_4274
ggatcggcgtcgtttcgctc

SEQ ID NO: 69022 - DNA, 20 bp, Artificial Sequence
  sgRNA
  NTC_4275
gtcgtcgtgtagcgatatac

SEQ ID NO: 69023 - DNA, 20 bp, Artificial Sequence
  sgRNA
  NTC_4276
ttgtctacacgctccgatgt

SEQ ID NO: 69024 - DNA, 20 bp, Artificial Sequence
  sgRNA
  NTC_4277
ctcggtcgattcgccatgcg

SEQ ID NO: 69025 - DNA, 20 bp, Artificial Sequence
  sgRNA
  NTC_4278
tcgacagtcgagcaacctaa

SEQ ID NO: 69026 - DNA, 20 bp, Artificial Sequence
  sgRNA
  NTC_4279
gacgacgttctattcgaagc

SEQ ID NO: 69027 - DNA, 20 bp, Artificial Sequence
  sgRNA
  NTC_4280
ggacgcgtaagaccgaacag

SEQ ID NO: 69028 - DNA, 20 bp, Artificial Sequence
  sgRNA
  NTC_4281
gcgatattcacgccatctac

SEQ ID NO: 69029 - DNA, 20 bp, Artificial Sequence
  sgRNA
  NTC_4282
acgacaactttacccgtatg

SEQ ID NO: 69030 - DNA, 20 bp, Artificial Sequence
  sgRNA
  NTC_4283
aacgtctaatacgtccaacc

SEQ ID NO: 69031 - DNA, 20 bp, Artificial Sequence
  sgRNA
  NTC_4284
ggatacggcgcgaaatcgtt

SEQ ID NO: 69032 - DNA, 20 bp, Artificial Sequence
  sgRNA
  NTC_4285
atcagaatcgtctccgctat

SEQ ID NO: 69033 - DNA, 20 bp, Artificial Sequence
  sgRNA
  NTC_4286
gcagatcgagatcgcttgcc

SEQ ID NO: 69034 - DNA, 20 bp, Artificial Sequence
  sgRNA
  NTC_4287
acttaacggtcgaactccgc

SEQ ID NO: 69035 - DNA, 20 bp, Artificial Sequence
  sgRNA
  NTC_4288
gcgtacgagcactcgaaaaa

SEQ ID NO: 69036 - DNA, 20 bp, Artificial Sequence
  sgRNA
  NTC_4289
aagcacggttgacccgctat

SEQ ID NO: 69037 - DNA, 20 bp, Artificial Sequence
  sgRNA
  NTC_4290
tagtgttaacgccgcccgat

SEQ ID NO: 69038 - DNA, 20 bp, Artificial Sequence
  sgRNA
  NTC_4291
acgtggtaaactagccccgt

SEQ ID NO: 69039 - DNA, 20 bp, Artificial Sequence
  sgRNA
  NTC_4292
ggctaagcacataacgatcg

SEQ ID NO: 69040 - DNA, 20 bp, Artificial Sequence
  sgRNA
  NTC_4293
atgtgtgattagcgctcgcg

SEQ ID NO: 69041 - DNA, 20 bp, Artificial Sequence
  sgRNA
  NTC_4294
acaggcttgctcattcgata

SEQ ID NO: 69042 - DNA, 20 bp, Artificial Sequence
  sgRNA
  NTC_4295
ctgttacggagtccaagtta

SEQ ID NO: 69043 - DNA, 20 bp, Artificial Sequence
  sgRNA
  NTC_4296
cgaagtaagtctacgcgccc

SEQ ID NO: 69044 - DNA, 20 bp, Artificial Sequence
  sgRNA
  NTC_4297
ttacgcgatcgacgctctac

SEQ ID NO: 69045 - DNA, 20 bp, Artificial Sequence
  sgRNA
  NTC_4298
agcggtacggtccgatctta

SEQ ID NO: 69046 - DNA, 20 bp, Artificial Sequence
  sgRNA
  NTC_4299
cttatcgtgcgcgccgaacc

SEQ ID NO: 69047 - DNA, 20 bp, Artificial Sequence
  sgRNA
  NTC_4300
tctgcgataacgcgtagatc

SEQ ID NO: 69048 - DNA, 20 bp, Artificial Sequence
  sgRNA
  NTC_4301
acgtcacgacactgctcccg

SEQ ID NO: 69049 - DNA, 20 bp, Artificial Sequence
  sgRNA
  NTC_4302
cgatatcgacggagcttacc

SEQ ID NO: 69050 - DNA, 20 bp, Artificial Sequence
  sgRNA
  NTC_4303
agggatatcgtactcaccgc

SEQ ID NO: 69051 - DNA, 20 bp, Artificial Sequence
  sgRNA
  NTC_4304
cgattaacgctctgacgacg

SEQ ID NO: 69052 - DNA, 20 bp, Artificial Sequence
  sgRNA
  NTC_4305
atcgcgcgtagtcgatgttt

SEQ ID NO: 69053 - DNA, 20 bp, Artificial Sequence
  sgRNA
  NTC_4306
cgatcgtattgcgctaatct

SEQ ID NO: 69054 - DNA, 20 bp, Artificial Sequence
  sgRNA
  NTC_4307
atgaacaagtcgtgccgaag

SEQ ID NO: 69055 - DNA, 20 bp, Artificial Sequence
  sgRNA
  NTC_4308
ggtgcggcatgttagtcgct

SEQ ID NO: 69056 - DNA, 20 bp, Artificial Sequence
  sgRNA
  NTC_4309
ggttacaactcgtacgaacc

SEQ ID NO: 69057 - DNA, 20 bp, Artificial Sequence
  sgRNA
  NTC_4310
acataatacgtccccgaccg

SEQ ID NO: 69058 - DNA, 20 bp, Artificial Sequence
  sgRNA
  NTC_4311
ttactcatggcattcgattg

SEQ ID NO: 69059 - DNA, 20 bp, Artificial Sequence
  sgRNA
  NTC_4312
ggcggacagcgagccaataa

SEQ ID NO: 69060 - DNA, 20 bp, Artificial Sequence
  sgRNA
  NTC_4313
cgacgttcgaacgtaccagc

SEQ ID NO: 69061 - DNA, 20 bp, Artificial Sequence
  sgRNA
  NTC_4314
taactctcattagacgacga

SEQ ID NO: 69062 - DNA, 20 bp, Artificial Sequence
  sgRNA
  NTC_4315
aacgtcggcgtagtgccgcg

SEQ ID NO: 69063 - DNA, 20 bp, Artificial Sequence
  sgRNA
  NTC_4316
gacgtacatcgccacgcatc

SEQ ID NO: 69064 - DNA, 20 bp, Artificial Sequence
  sgRNA
  NTC_4317
agcacggttcgcgttactta

SEQ ID NO: 69065 - DNA, 20 bp, Artificial Sequence
  sgRNA
  NTC_4318
agtcgctttgaccgcccaca

SEQ ID NO: 69066 - DNA, 20 bp, Artificial Sequence
  sgRNA
  NTC_4319
cgacgacttatgtcgcgtgt

SEQ ID NO: 69067 - DNA, 20 bp, Artificial Sequence
  sgRNA
  NTC_4320
gtttcgtagattatcgttgc

SEQ ID NO: 69068 - DNA, 20 bp, Artificial Sequence
  sgRNA
  NTC_4321
atagcgtacgatgcccgcga

SEQ ID NO: 69069 - DNA, 20 bp, Artificial Sequence
  sgRNA
  NTC_4322
gttcgcgacgctatactcat

SEQ ID NO: 69070 - DNA, 20 bp, Artificial Sequence
  sgRNA
  NTC_4323
gcgttcaattgaccacgatt

SEQ ID NO: 69071 - DNA, 20 bp, Artificial Sequence
  sgRNA
  NTC_4324
cgcgcagtcgagcgtaaaaa

SEQ ID NO: 69072 - DNA, 20 bp, Artificial Sequence
  sgRNA
  NTC_4325
ctcgcgaggttcgataactt

SEQ ID NO: 69073 - DNA, 20 bp, Artificial Sequence
  sgRNA
  NTC_4326
agcgatcgtaagcgccttca

SEQ ID NO: 69074 - DNA, 20 bp, Artificial Sequence
  sgRNA
  NTC_4327
gacgaaaaaacgcgcacgca

SEQ ID NO: 69075 - DNA, 20 bp, Artificial Sequence
  sgRNA
  NTC_4328
gtcggcaagtagcgcgtcgc

SEQ ID NO: 69076 - DNA, 20 bp, Artificial Sequence
  sgRNA
  NTC_4329
acgcatgaaggtcccgcacg

SEQ ID NO: 69077 - DNA, 20 bp, Artificial Sequence
  sgRNA
  NTC_4330
cttcgacgggttacgcgtcg

SEQ ID NO: 69078 - DNA, 20 bp, Artificial Sequence
  sgRNA
  NTC_4331
gaacgcgagacgcacgcttt

SEQ ID NO: 69079 - DNA, 20 bp, Artificial Sequence
  sgRNA
  NTC_4332
gtttcgcttcgcgctaacgc

SEQ ID NO: 69080 - DNA, 20 bp, Artificial Sequence
  sgRNA
  NTC_4333
gtctacgcacgatccgctag

SEQ ID NO: 69081 - DNA, 20 bp, Artificial Sequence
  sgRNA
  NTC_4334
aggacggagtacatcatatc

SEQ ID NO: 69082 - DNA, 20 bp, Artificial Sequence
  sgRNA
  NTC_4335
tgaactagcgagtccgtgaa

SEQ ID NO: 69083 - DNA, 20 bp, Artificial Sequence
  sgRNA
  NTC_4336
cggtcgtcgaggaacgtgca

SEQ ID NO: 69084 - DNA, 20 bp, Artificial Sequence
  sgRNA
  NTC_4337
gctgcggctgataacgagtg

SEQ ID NO: 69085 - DNA, 20 bp, Artificial Sequence
  sgRNA
  NTC_4338
acaacgcgattagacgtgac

SEQ ID NO: 69086 - DNA, 20 bp, Artificial Sequence
  sgRNA
  NTC_4339
atgacgactaacccgacgtt

SEQ ID NO: 69087 - DNA, 20 bp, Artificial Sequence
  sgRNA
  NTC_4340
gctcgatggagcgacgacct

SEQ ID NO: 69088 - DNA, 20 bp, Artificial Sequence
  sgRNA
  NTC_4341
taacggagttaacgcgcttt

SEQ ID NO: 69089 - DNA, 20 bp, Artificial Sequence
  sgRNA
  NTC_4342
caatcgaataggaccgcatt

SEQ ID NO: 69090 - DNA, 20 bp, Artificial Sequence
  sgRNA
  NTC_4343
gggttggaatgcgatcctcc

SEQ ID NO: 69091 - DNA, 20 bp, Artificial Sequence
  sgRNA
  NTC_4344
gcttacgttcgccgcgaacc

SEQ ID NO: 69092 - DNA, 20 bp, Artificial Sequence
  sgRNA
  NTC_4345
tctacgggagtacgcactac

SEQ ID NO: 69093 - DNA, 20 bp, Artificial Sequence
  sgRNA
  NTC_4346
tgagcgatgtattgcgcgag

SEQ ID NO: 69094 - DNA, 20 bp, Artificial Sequence
  sgRNA
  NTC_4347
cgttaacatggactccgtac

SEQ ID NO: 69095 - DNA, 20 bp, Artificial Sequence
  sgRNA
  NTC_4348
aggctcgtcttcgacacgcc

SEQ ID NO: 69096 - DNA, 20 bp, Artificial Sequence
  sgRNA
  NTC_4349
taactaactcgtttcacgcg

SEQ ID NO: 69097 - DNA, 20 bp, Artificial Sequence
  sgRNA
  NTC_4350
cgcacgtttcacgtcgatag

SEQ ID NO: 69098 - DNA, 20 bp, Artificial Sequence
  sgRNA
  NTC_4351
gtaaaggcgtaacgccgtac

SEQ ID NO: 69099 - DNA, 20 bp, Artificial Sequence
  sgRNA
  NTC_4352
gaatgtttacggaccgaagc

SEQ ID NO: 69100 - DNA, 20 bp, Artificial Sequence
  sgRNA
  NTC_4353
tgagcactcactacgtaacg

SEQ ID NO: 69101 - DNA, 20 bp, Artificial Sequence
  sgRNA
  NTC_4354
tcattgttatcgcacgaccc

SEQ ID NO: 69102 - DNA, 20 bp, Artificial Sequence
  sgRNA
  NTC_4355
cggacgtcaatccttatgac

SEQ ID NO: 69103 - DNA, 20 bp, Artificial Sequence
  sgRNA
  NTC_4356
gcagtaacggataaccgtaa

SEQ ID NO: 69104 - DNA, 20 bp, Artificial Sequence
  sgRNA
  NTC_4357
acggttgtgcgttgaatcgc

SEQ ID NO: 69105 - DNA, 20 bp, Artificial Sequence
  sgRNA
  NTC_4358
tagcgtacgtctttcgtaag

SEQ ID NO: 69106 - DNA, 20 bp, Artificial Sequence
  sgRNA
  NTC_4359
gtttaagtggagcgactact

SEQ ID NO: 69107 - DNA, 20 bp, Artificial Sequence
  sgRNA
  NTC_4360
cgaataacagtcgaccgacg

SEQ ID NO: 69108 - DNA, 20 bp, Artificial Sequence
  sgRNA
  NTC_4361
ggatgacgaatcgtcatagc

SEQ ID NO: 69109 - DNA, 20 bp, Artificial Sequence
  sgRNA
  NTC_4362
gttcacgaacgtcgcgttag

SEQ ID NO: 69110 - DNA, 20 bp, Artificial Sequence
  sgRNA
  NTC_4363
ttactttaagcgacccgttg

SEQ ID NO: 69111 - DNA, 20 bp, Artificial Sequence
  sgRNA
  NTC_4364
gactactcgtgcgattgcgt

SEQ ID NO: 69112 - DNA, 20 bp, Artificial Sequence
  sgRNA
  NTC_4365
tggcgtacgagtcgcacgat

SEQ ID NO: 69113 - DNA, 20 bp, Artificial Sequence
  sgRNA
  NTC_4366
gacgcgacggaacatcgact

SEQ ID NO: 69114 - DNA, 20 bp, Artificial Sequence
  sgRNA
  NTC_4367
acacggcgcgcatcacgaat

SEQ ID NO: 69115 - DNA, 20 bp, Artificial Sequence
  sgRNA
  NTC_4368
caggttaaggatcgtacact

SEQ ID NO: 69116 - DNA, 20 bp, Artificial Sequence
  sgRNA
  NTC_4369
tcgagagtataagacgctag

SEQ ID NO: 69117 - DNA, 20 bp, Artificial Sequence
  sgRNA
  NTC_4370
cgtagtttgcgacgacgtaa

SEQ ID NO: 69118 - DNA, 20 bp, Artificial Sequence
  sgRNA
  NTC_4371
ctcaagctcggcattcgata

SEQ ID NO: 69119 - DNA, 20 bp, Artificial Sequence
  sgRNA
  NTC_4372
tcgcgagtgcgttgccaatt

SEQ ID NO: 69120 - DNA, 20 bp, Artificial Sequence
  sgRNA
  NTC_4373
cgtaatctcgtgtcgttaag

SEQ ID NO: 69121 - DNA, 20 bp, Artificial Sequence
  sgRNA
  NTC_4374
ggcgcaatcaataccgtttg

SEQ ID NO: 69122 - DNA, 20 bp, Artificial Sequence
  sgRNA
  NTC_4375
ggaaggttcgcgcgccatat

SEQ ID NO: 69123 - DNA, 20 bp, Artificial Sequence
  sgRNA
  NTC_4376
cggtcgtgcgatctcgcgtt

SEQ ID NO: 69124 - DNA, 20 bp, Artificial Sequence
  sgRNA
  NTC_4377
gagctcacgatgcgcaattc

SEQ ID NO: 69125 - DNA, 20 bp, Artificial Sequence
  sgRNA
  NTC_4378
tgggtctcatgcgacgagta

SEQ ID NO: 69126 - DNA, 20 bp, Artificial Sequence
  sgRNA
  NTC_4379
acaacgggtacgtcgacaga

SEQ ID NO: 69127 - DNA, 20 bp, Artificial Sequence
  sgRNA
  NTC_4380
acgattcgcgggttcacgtt

SEQ ID NO: 69128 - DNA, 20 bp, Artificial Sequence
  sgRNA
  NTC_4381
tcgagtacgttcaactcgcg

SEQ ID NO: 69129 - DNA, 20 bp, Artificial Sequence
  sgRNA
  NTC_4382
ggattggcggcgaacttcgt

SEQ ID NO: 69130 - DNA, 20 bp, Artificial Sequence
  sgRNA
  NTC_4383
ggctcgactcgcgacttgcc

SEQ ID NO: 69131 - DNA, 20 bp, Artificial Sequence
  sgRNA
  NTC_4384
cgcatgctcaaatcgccgag

SEQ ID NO: 69132 - DNA, 20 bp, Artificial Sequence
  sgRNA
  NTC_4385
tagcggctactcgcgtcgac

SEQ ID NO: 69133 - DNA, 20 bp, Artificial Sequence
  sgRNA
  NTC_4386
acgggcgcgctgatcgagct

SEQ ID NO: 69134 - DNA, 20 bp, Artificial Sequence
  sgRNA
  NTC_4387
cacgtcaatcatattcgcgt

SEQ ID NO: 69135 - DNA, 20 bp, Artificial Sequence
  sgRNA
  NTC_4388
tatgcgcggacgctagcacc

SEQ ID NO: 69136 - DNA, 20 bp, Artificial Sequence
  sgRNA
  NTC_4389
acggcactggatacgatatc

SEQ ID NO: 69137 - DNA, 20 bp, Artificial Sequence
  sgRNA
  NTC_4390
cgcgtctagcgccccaagca

SEQ ID NO: 69138 - DNA, 20 bp, Artificial Sequence
  sgRNA
  NTC_4391
aatttgagcggcgcccttac

SEQ ID NO: 69139 - DNA, 20 bp, Artificial Sequence
  sgRNA
  NTC_4392
tctaatgtcgaccgctacgt

SEQ ID NO: 69140 - DNA, 20 bp, Artificial Sequence
  sgRNA
  NTC_4393
gattggcgcgaatcattccg

SEQ ID NO: 69141 - DNA, 20 bp, Artificial Sequence
  sgRNA
  NTC_4394
tcactatctcgtgtcgccat

SEQ ID NO: 69142 - DNA, 20 bp, Artificial Sequence
  sgRNA
  NTC_4395
gatacatttagacgcccgat

SEQ ID NO: 69143 - DNA, 20 bp, Artificial Sequence
  sgRNA
  NTC_4396
atggggatagcgcgcgattt

SEQ ID NO: 69144 - DNA, 20 bp, Artificial Sequence
  sgRNA
  NTC_4397
gtgctaacgcaacttcgatt

SEQ ID NO: 69145 - DNA, 20 bp, Artificial Sequence
  sgRNA
  NTC_4398
gtgacgagcgctctcgcgat

SEQ ID NO: 69146 - DNA, 20 bp, Artificial Sequence
  sgRNA
  NTC_4399
ggtgtgcactcgactagttt

SEQ ID NO: 69147 - DNA, 20 bp, Artificial Sequence
  sgRNA
  NTC_4400
cggatcgcgtgaacgccatc

SEQ ID NO: 69148 - DNA, 20 bp, Artificial Sequence
  sgRNA
  NTC_4401
gtcacgacgacgttccatat

SEQ ID NO: 69149 - DNA, 20 bp, Artificial Sequence
  sgRNA
  NTC_4402
atcaaacaacaccgcgcgtg

SEQ ID NO: 69150 - DNA, 20 bp, Artificial Sequence
  sgRNA
  NTC_4403
gttcggctaatcgtatagcg

SEQ ID NO: 69151 - DNA, 20 bp, Artificial Sequence
  sgRNA
  NTC_4404
aatcgtgtcgctcctcgtga

SEQ ID NO: 69152 - DNA, 20 bp, Artificial Sequence
  sgRNA
  NTC_4405
tcatttgaaacgcgttgcga

SEQ ID NO: 69153 - DNA, 20 bp, Artificial Sequence
  sgRNA
  NTC_4406
tcttcagtcatgcgcgtacc

SEQ ID NO: 69154 - DNA, 20 bp, Artificial Sequence
  sgRNA
  NTC_4407
ttatagtagtcgcctcacgc

SEQ ID NO: 69155 - DNA, 20 bp, Artificial Sequence
  sgRNA
  NTC_4408
acgctgcgtaaactaatacg

SEQ ID NO: 69156 - DNA, 20 bp, Artificial Sequence
  sgRNA
  NTC_4409
cgagaaaggtcgtcgacgcc

SEQ ID NO: 69157 - DNA, 20 bp, Artificial Sequence
  sgRNA
  NTC_4410
cacgaacgctggatcgaccg

SEQ ID NO: 69158 - DNA, 20 bp, Artificial Sequence
  sgRNA
  NTC_4411
agcaaggtaacacgtcgcgt

SEQ ID NO: 69159 - DNA, 20 bp, Artificial Sequence
  sgRNA
  NTC_4412
ggtcaagtataagtaacgac

SEQ ID NO: 69160 - DNA, 20 bp, Artificial Sequence
  sgRNA
  NTC_4413
gcgcaacgcgaaatcacgac

SEQ ID NO: 69161 - DNA, 20 bp, Artificial Sequence
  sgRNA
  NTC_4414
gcgctggtcatacccgcgat

SEQ ID NO: 69162 - DNA, 20 bp, Artificial Sequence
  sgRNA
  NTC_4415
gttgatgcgttaaacgagtc

SEQ ID NO: 69163 - DNA, 20 bp, Artificial Sequence
  sgRNA
  NTC_4416
tcgatgactcggtttaagca

SEQ ID NO: 69164 - DNA, 20 bp, Artificial Sequence
  sgRNA
  NTC_4417
tctcgagtttactccgaacg

SEQ ID NO: 69165 - DNA, 20 bp, Artificial Sequence
  sgRNA
  NTC_4418
agagatttgactcgcgctcg

SEQ ID NO: 69166 - DNA, 20 bp, Artificial Sequence
  sgRNA
  NTC_4419
cgaaaacgcgcgccccgtta

SEQ ID NO: 69167 - DNA, 20 bp, Artificial Sequence
  sgRNA
  NTC_4420
ctcgcaagacagcgtacgtc

SEQ ID NO: 69168 - DNA, 20 bp, Artificial Sequence
  sgRNA
  NTC_4421
ggagggtctcgatgcgctat

SEQ ID NO: 69169 - DNA, 20 bp, Artificial Sequence
  sgRNA
  NTC_4422
ggtacgcttatgcgcgattt

SEQ ID NO: 69170 - DNA, 20 bp, Artificial Sequence
  sgRNA
  NTC_4423
gcgagcgacgcgataaccgc

SEQ ID NO: 69171 - DNA, 20 bp, Artificial Sequence
  sgRNA
  NTC_4424
cttaagcgtacgaacgaatc

SEQ ID NO: 69172 - DNA, 20 bp, Artificial Sequence
  sgRNA
  NTC_4425
ctcgcagctagatcgaccgt

SEQ ID NO: 69173 - DNA, 20 bp, Artificial Sequence
  sgRNA
  NTC_4426
ttataggacgggcttgcgcg

SEQ ID NO: 69174 - DNA, 20 bp, Artificial Sequence
  sgRNA
  NTC_4427
ctactaacgtgcaccgcgtg

SEQ ID NO: 69175 - DNA, 20 bp, Artificial Sequence
  sgRNA
  NTC_4428
aatctgctggcgatcgcaag

SEQ ID NO: 69176 - DNA, 20 bp, Artificial Sequence
  sgRNA
  NTC_4429
caaacggtcagcccataacg

SEQ ID NO: 69177 - DNA, 20 bp, Artificial Sequence
  sgRNA
  NTC_4430
cgtttaattgtatcgcgtcc

SEQ ID NO: 69178 - DNA, 20 bp, Artificial Sequence
  sgRNA
  NTC_4431
cgcggtagtcgttgttcgtt

SEQ ID NO: 69179 - DNA, 20 bp, Artificial Sequence
  sgRNA
  NTC_4432
tagggcgtacgtcataaagt

SEQ ID NO: 69180 - DNA, 20 bp, Artificial Sequence
  sgRNA
  NTC_4433
tacgcgatagcgcagaaccc

SEQ ID NO: 69181 - DNA, 20 bp, Artificial Sequence
  sgRNA
  NTC_4434
gtcgcggtttagcctaccca

SEQ ID NO: 69182 - DNA, 20 bp, Artificial Sequence
  sgRNA
  NTC_4435
cgacgttaatctagcgccgt

SEQ ID NO: 69183 - DNA, 20 bp, Artificial Sequence
  sgRNA
  NTC_4436
acgcgtacagacgagtacgt

SEQ ID NO: 69184 - DNA, 20 bp, Artificial Sequence
  sgRNA
  NTC_4437
gacggacgggtacgcctgct

SEQ ID NO: 69185 - DNA, 20 bp, Artificial Sequence
  sgRNA
  NTC_4438
caagcgcgatgcagccacgt

SEQ ID NO: 69186 - DNA, 20 bp, Artificial Sequence
  sgRNA
  NTC_4439
aatcggttcggactatctta

SEQ ID NO: 69187 - DNA, 20 bp, Artificial Sequence
  sgRNA
  NTC_4440
tcgtaagatctgacgacgcg

SEQ ID NO: 69188 - DNA, 20 bp, Artificial Sequence
  sgRNA
  NTC_4441
cgcgtcgcgactctcgttaa

SEQ ID NO: 69189 - DNA, 20 bp, Artificial Sequence
  sgRNA
  NTC_4442
cgatcgtacgcagtcaactg

SEQ ID NO: 69190 - DNA, 20 bp, Artificial Sequence
  sgRNA
  NTC_4443
gttcgtcactacattaccgc

SEQ ID NO: 69191 - DNA, 20 bp, Artificial Sequence
  sgRNA
  NTC_4444
tgatagctcagtcgttcgcg

SEQ ID NO: 69192 - DNA, 20 bp, Artificial Sequence
  sgRNA
  NTC_4445
atatcttgacgaagcgcaat

SEQ ID NO: 69193 - DNA, 20 bp, Artificial Sequence
  sgRNA
  NTC_4446
tgtatctcgatcaacgcacg

SEQ ID NO: 69194 - DNA, 20 bp, Artificial Sequence
  sgRNA
  NTC_4447
cgcagtcgtcggattacgac

SEQ ID NO: 69195 - DNA, 20 bp, Artificial Sequence
  sgRNA
  NTC_4448
gtgcgtcggaagatatcgat

SEQ ID NO: 69196 - DNA, 20 bp, Artificial Sequence
  sgRNA
  NTC_4449
tggcatcgactaacgacgac

SEQ ID NO: 69197 - DNA, 20 bp, Artificial Sequence
  sgRNA
  NTC_4450
acgtcggggtacttgcgctc

SEQ ID NO: 69198 - DNA, 20 bp, Artificial Sequence
  sgRNA
  NTC_4451
tctgctcgaactcgaagtgt

SEQ ID NO: 69199 - DNA, 20 bp, Artificial Sequence
  sgRNA
  NTC_4452
atctagtcacgccgcgctgt

SEQ ID NO: 69200 - DNA, 20 bp, Artificial Sequence
  sgRNA
  NTC_4453
taggacggatggtccgcgct

SEQ ID NO: 69201 - DNA, 20 bp, Artificial Sequence
  sgRNA
  NTC_4454
gcacgtgtgataccgtacgt

SEQ ID NO: 69202 - DNA, 20 bp, Artificial Sequence
  sgRNA
  NTC_4455
tcacggcgacgctcgccaat

SEQ ID NO: 69203 - DNA, 20 bp, Artificial Sequence
  sgRNA
  NTC_4456
cggattggcgcgctcgtacg

SEQ ID NO: 69204 - DNA, 20 bp, Artificial Sequence
  sgRNA
  NTC_4457
cggttgcacggacgcatcga

SEQ ID NO: 69205 - DNA, 20 bp, Artificial Sequence
  sgRNA
  NTC_4458
actatcgatacgaatgtcgt

SEQ ID NO: 69206 - DNA, 20 bp, Artificial Sequence
  sgRNA
  NTC_4459
cggtaagaatcgccgcatga

SEQ ID NO: 69207 - DNA, 20 bp, Artificial Sequence
  sgRNA
  NTC_4460
tattctcgcagtatcgaccg

SEQ ID NO: 69208 - DNA, 20 bp, Artificial Sequence
  sgRNA
  NTC_4461
cggtcggctattaatcaacg

SEQ ID NO: 69209 - DNA, 20 bp, Artificial Sequence
  sgRNA
  NTC_4462
atacgcggtataacccaacg

SEQ ID NO: 69210 - DNA, 20 bp, Artificial Sequence
  sgRNA
  NTC_4463
cgaatcgcacggtccgcata

SEQ ID NO: 69211 - DNA, 20 bp, Artificial Sequence
  sgRNA
  NTC_4464
ttctcggcgcgctcgcaatc

SEQ ID NO: 69212 - DNA, 20 bp, Artificial Sequence
  sgRNA
  NTC_4465
cgcagaaataaacgctcctc

SEQ ID NO: 69213 - DNA, 20 bp, Artificial Sequence
  sgRNA
  NTC_4466
cgtagcgagttagtcaatac

SEQ ID NO: 69214 - DNA, 20 bp, Artificial Sequence
  sgRNA
  NTC_4467
ggcgtgcgtctcgtgagatc

SEQ ID NO: 69215 - DNA, 20 bp, Artificial Sequence
  sgRNA
  NTC_4468
cgcaattacgctagcgccca

SEQ ID NO: 69216 - DNA, 20 bp, Artificial Sequence
  sgRNA
  NTC_4469
gacggattgagctcgactta

SEQ ID NO: 69217 - DNA, 20 bp, Artificial Sequence
  sgRNA
  NTC_4470
gacggcatcgtccgctatcg

SEQ ID NO: 69218 - DNA, 20 bp, Artificial Sequence
  sgRNA
  NTC_4471
gctcacaggaatgacgaacg

SEQ ID NO: 69219 - DNA, 20 bp, Artificial Sequence
  sgRNA
  NTC_4472
gacgtgaatcgcaccgcgct

SEQ ID NO: 69220 - DNA, 20 bp, Artificial Sequence
  sgRNA
  NTC_4473
gagacttagtttccgcgcgt

SEQ ID NO: 69221 - DNA, 20 bp, Artificial Sequence
  sgRNA
  NTC_4474
cgcaatatcgctcgcgctta

SEQ ID NO: 69222 - DNA, 20 bp, Artificial Sequence
  sgRNA
  NTC_4475
aaggatcatgtaaccgacat

SEQ ID NO: 69223 - DNA, 20 bp, Artificial Sequence
  sgRNA
  NTC_4476
cgtaggtcacggatcgcgcg

SEQ ID NO: 69224 - DNA, 20 bp, Artificial Sequence
  sgRNA
  NTC_4477
tgcgagacggtatgcaagac

SEQ ID NO: 69225 - DNA, 20 bp, Artificial Sequence
  sgRNA
  NTC_4478
tatcgtcgctttcgaacgag

SEQ ID NO: 69226 - DNA, 20 bp, Artificial Sequence
  sgRNA
  NTC_4479
ggctaggtaactcgttcgac

SEQ ID NO: 69227 - DNA, 20 bp, Artificial Sequence
  sgRNA
  NTC_4480
gatcggcactaaacgccgcg

SEQ ID NO: 69228 - DNA, 20 bp, Artificial Sequence
  sgRNA
  NTC_4481
aattgcagctcgatcgattt

SEQ ID NO: 69229 - DNA, 20 bp, Artificial Sequence
  sgRNA
  NTC_4482
ggtcgtacaatcgttctcga

SEQ ID NO: 69230 - DNA, 20 bp, Artificial Sequence
  sgRNA
  NTC_4483
gcgcgcgcatgaactatcgc

SEQ ID NO: 69231 - DNA, 20 bp, Artificial Sequence
  sgRNA
  NTC_4484
tgcgcgtgtacgcccgttaa

SEQ ID NO: 69232 - DNA, 20 bp, Artificial Sequence
  sgRNA
  NTC_4485
cgtagcgacgcattcgacat

SEQ ID NO: 69233 - DNA, 20 bp, Artificial Sequence
  sgRNA
  NTC_4486
gtacgcttacgaccagtcgc

SEQ ID NO: 69234 - DNA, 20 bp, Artificial Sequence
  sgRNA
  NTC_4487
gtatcgcgtcgtaagccgcg

SEQ ID NO: 69235 - DNA, 20 bp, Artificial Sequence
  sgRNA
  NTC_4488
tttcggactttcgacagccg

SEQ ID NO: 69236 - DNA, 20 bp, Artificial Sequence
  sgRNA
  NTC_4489
gcgggctcgctgttcgtcgt

SEQ ID NO: 69237 - DNA, 20 bp, Artificial Sequence
  sgRNA
  NTC_4490
tgtctggcgctacacgtttg

SEQ ID NO: 69238 - DNA, 20 bp, Artificial Sequence
  sgRNA
  NTC_4491
ggctcgtgtaagcgcatata

SEQ ID NO: 69239 - DNA, 20 bp, Artificial Sequence
  sgRNA
  NTC_4492
atacgtgcgtcttgcccgtc

SEQ ID NO: 69240 - DNA, 20 bp, Artificial Sequence
  sgRNA
  NTC_4493
actgcgacgagacgtaatgt

SEQ ID NO: 69241 - DNA, 20 bp, Artificial Sequence
  sgRNA
  NTC_4494
tcggatacgtattagtcgta

SEQ ID NO: 69242 - DNA, 20 bp, Artificial Sequence
  sgRNA
  NTC_4495
acgtctcggattcgccaata

SEQ ID NO: 69243 - DNA, 20 bp, Artificial Sequence
  sgRNA
  NTC_4496
gcttcgcgtcgcgtacttct

SEQ ID NO: 69244 - DNA, 20 bp, Artificial Sequence
  sgRNA
  NTC_4497
cggagtactgaacgacctgt

SEQ ID NO: 69245 - DNA, 20 bp, Artificial Sequence
  sgRNA
  NTC_4498
gcggtcgatcgcgccaatta

SEQ ID NO: 69246 - DNA, 20 bp, Artificial Sequence
  sgRNA
  NTC_4499
cgggtcacggcgacgctatc

SEQ ID NO: 69247 - DNA, 20 bp, Artificial Sequence
  sgRNA
  NTC_4500
gatactgaatgccgcgtact

SEQ ID NO: 69248 - DNA, 20 bp, Artificial Sequence
  sgRNA
  NTC_4501
gactttgcgaggtcgccaat

SEQ ID NO: 69249 - DNA, 20 bp, Artificial Sequence
  sgRNA
  NTC_4502
cgaacgggtgatacgacgac

SEQ ID NO: 69250 - DNA, 20 bp, Artificial Sequence
  sgRNA
  NTC_4503
taattcggatatcgtgcgag

SEQ ID NO: 69251 - DNA, 20 bp, Artificial Sequence
  sgRNA
  NTC_4504
agctcgcgaactcgcacgac

SEQ ID NO: 69252 - DNA, 20 bp, Artificial Sequence
  sgRNA
  NTC_4505
cagttgagtagcgcccgtac

SEQ ID NO: 69253 - DNA, 20 bp, Artificial Sequence
  sgRNA
  NTC_4506
tataattattggcgtctcgc

SEQ ID NO: 69254 - DNA, 20 bp, Artificial Sequence
  sgRNA
  NTC_4507
ttggtgtgcgcgtcaatccg

SEQ ID NO: 69255 - DNA, 20 bp, Artificial Sequence
  sgRNA
  NTC_4508
tcggatcggatcgacgcaag

SEQ ID NO: 69256 - DNA, 20 bp, Artificial Sequence
  sgRNA
  NTC_4509
tatggatcatacgcgtccaa

SEQ ID NO: 69257 - DNA, 20 bp, Artificial Sequence
  sgRNA
  NTC_4510
cgctttgatagtaccgctat

SEQ ID NO: 69258 - DNA, 20 bp, Artificial Sequence
  sgRNA
  NTC_4511
gcgcgggactttacgacctg

SEQ ID NO: 69259 - DNA, 20 bp, Artificial Sequence
  sgRNA
  NTC_4512
aagtatcagcgcgcgcaagt

SEQ ID NO: 69260 - DNA, 20 bp, Artificial Sequence
  sgRNA
  NTC_4513
ggggcgatatcgtaacgctg

SEQ ID NO: 69261 - DNA, 20 bp, Artificial Sequence
  sgRNA
  NTC_4514
aatcgttggcgcgaacgaac

SEQ ID NO: 69262 - DNA, 20 bp, Artificial Sequence
  sgRNA
  NTC_4515
taggcagaagcgcgattcga

SEQ ID NO: 69263 - DNA, 20 bp, Artificial Sequence
  sgRNA
  NTC_4516
tcttgatcgatacgcacgat

SEQ ID NO: 69264 - DNA, 20 bp, Artificial Sequence
  sgRNA
  NTC_4517
caatgcgaatcacctacgta

SEQ ID NO: 69265 - DNA, 20 bp, Artificial Sequence
  sgRNA
  NTC_4518
caatctacaacgattacgcg

SEQ ID NO: 69266 - DNA, 20 bp, Artificial Sequence
  sgRNA
  NTC_4519
tattcatcgatacgcgagcc

SEQ ID NO: 69267 - DNA, 20 bp, Artificial Sequence
  sgRNA
  NTC_4520
taaatgatgcgtaacgcgcg

SEQ ID NO: 69268 - DNA, 20 bp, Artificial Sequence
  sgRNA
  NTC_4521
tactacggacgacgctcgta

SEQ ID NO: 69269 - DNA, 20 bp, Artificial Sequence
  sgRNA
  NTC_4522
aataattgggcgcacccatt

SEQ ID NO: 69270 - DNA, 20 bp, Artificial Sequence
  sgRNA
  NTC_4523
aggggatttatgccgatcga

SEQ ID NO: 69271 - DNA, 20 bp, Artificial Sequence
  sgRNA
  NTC_4524
aacgaagcgggatcgcctga

SEQ ID NO: 69272 - DNA, 20 bp, Artificial Sequence
  sgRNA
  NTC_4525
gcacggttggtacgatactc

SEQ ID NO: 69273 - DNA, 20 bp, Artificial Sequence
  sgRNA
  NTC_4526
tcaacaattggtcgcgcgac

SEQ ID NO: 69274 - DNA, 20 bp, Artificial Sequence
  sgRNA
  NTC_4527
ttgtcgggggcgccaattcg

SEQ ID NO: 69275 - DNA, 20 bp, Artificial Sequence
  sgRNA
  NTC_4528
gatcggtattgtgcgccgca

SEQ ID NO: 69276 - DNA, 20 bp, Artificial Sequence
  sgRNA
  NTC_4529
cggtgaagtgcgagttcgtg

SEQ ID NO: 69277 - DNA, 20 bp, Artificial Sequence
  sgRNA
  NTC_4530
gtactgaggatgcccgactt

SEQ ID NO: 69278 - DNA, 20 bp, Artificial Sequence
  sgRNA
  NTC_4531
gtgactgcaagacgctattt

SEQ ID NO: 69279 - DNA, 20 bp, Artificial Sequence
  sgRNA
  NTC_4532
acactgattcgagccgaccg

SEQ ID NO: 69280 - DNA, 20 bp, Artificial Sequence
  sgRNA
  NTC_4533
gctaagcgtttgatcgcgta

SEQ ID NO: 69281 - DNA, 20 bp, Artificial Sequence
  sgRNA
  NTC_4534
cgaacgcggctacctcctat

SEQ ID NO: 69282 - DNA, 20 bp, Artificial Sequence
  sgRNA
  NTC_4535
gttcggagttctcgcgttta

SEQ ID NO: 69283 - DNA, 20 bp, Artificial Sequence
  sgRNA
  NTC_4536
gcaagtttcgcagcgacgtt

SEQ ID NO: 69284 - DNA, 20 bp, Artificial Sequence
  sgRNA
  NTC_4537
tgcgctatatggttacgaca

SEQ ID NO: 69285 - DNA, 20 bp, Artificial Sequence
  sgRNA
  NTC_4538
gcgctacattcgtcgccgat

SEQ ID NO: 69286 - DNA, 20 bp, Artificial Sequence
  sgRNA
  NTC_4539
ctcggtctaaaatacgtcta

SEQ ID NO: 69287 - DNA, 20 bp, Artificial Sequence
  sgRNA
  NTC_4540
attatgcgggcgtctcccat

SEQ ID NO: 69288 - DNA, 20 bp, Artificial Sequence
  sgRNA
  NTC_4541
ctatgctttcgcgatataac

SEQ ID NO: 69289 - DNA, 20 bp, Artificial Sequence
  sgRNA
  NTC_4542
acaacgtgtcgcgatcgtaa

SEQ ID NO: 69290 - DNA, 20 bp, Artificial Sequence
  sgRNA
  NTC_4543
gcaaatcgacgagtagcgac

SEQ ID NO: 69291 - DNA, 20 bp, Artificial Sequence
  sgRNA
  NTC_4544
ggtactcgcgcagctcgtgt

SEQ ID NO: 69292 - DNA, 20 bp, Artificial Sequence
  sgRNA
  NTC_4545
tcgagggaagcatacgctta

SEQ ID NO: 69293 - DNA, 20 bp, Artificial Sequence
  sgRNA
  NTC_4546
gtgtcgcgtaaaacgcgacc

SEQ ID NO: 69294 - DNA, 20 bp, Artificial Sequence
  sgRNA
  NTC_4547
atgtgagtataacgcgcaat

SEQ ID NO: 69295 - DNA, 20 bp, Artificial Sequence
  sgRNA
  NTC_4548
cgttagagctcgcgcaaaac

SEQ ID NO: 69296 - DNA, 20 bp, Artificial Sequence
  sgRNA
  NTC_4549
agtacggcacagaccgtatc

SEQ ID NO: 69297 - DNA, 20 bp, Artificial Sequence
  sgRNA
  NTC_4550
atagcataacacgcgatcga

SEQ ID NO: 69298 - DNA, 20 bp, Artificial Sequence
  sgRNA
  NTC_4551
tgcacgcgcgtaactcctta

SEQ ID NO: 69299 - DNA, 20 bp, Artificial Sequence
  sgRNA
  NTC_4552
tggcgattcgtgtgcgcctc

SEQ ID NO: 69300 - DNA, 20 bp, Artificial Sequence
  sgRNA
  NTC_4553
ggctctaagtaacgccgtta

SEQ ID NO: 69301 - DNA, 20 bp, Artificial Sequence
  sgRNA
  NTC_4554
gtgatcacgtatgccgttag

SEQ ID NO: 69302 - DNA, 20 bp, Artificial Sequence
  sgRNA
  NTC_4555
tacgcgcgttagacttagta

SEQ ID NO: 69303 - DNA, 20 bp, Artificial Sequence
  sgRNA
  NTC_4556
atgttgtggcatcacgcgcg

SEQ ID NO: 69304 - DNA, 20 bp, Artificial Sequence
  sgRNA
  NTC_4557
gtaacgcgctggtccattaa

SEQ ID NO: 69305 - DNA, 20 bp, Artificial Sequence
  sgRNA
  NTC_4558
gttcgctcgtatcgtccaca

SEQ ID NO: 69306 - DNA, 20 bp, Artificial Sequence
  sgRNA
  NTC_4559
gcttgggaactcatcgcgcc

SEQ ID NO: 69307 - DNA, 20 bp, Artificial Sequence
  sgRNA
  NTC_4560
gcgctacgcgttaagcctaa

SEQ ID NO: 69308 - DNA, 20 bp, Artificial Sequence
  sgRNA
  NTC_4561
atataggtcgcgatcactta

SEQ ID NO: 69309 - DNA, 20 bp, Artificial Sequence
  sgRNA
  NTC_4562
atcgctggcgcgcgataagt

SEQ ID NO: 69310 - DNA, 20 bp, Artificial Sequence
  sgRNA
  NTC_4563
agaacgcgtgttattgcgta

SEQ ID NO: 69311 - DNA, 20 bp, Artificial Sequence
  sgRNA
  NTC_4564
tacgggacagatatcccgcg

SEQ ID NO: 69312 - DNA, 20 bp, Artificial Sequence
  sgRNA
  NTC_4565
gcacgcgcgtcacgacagta

SEQ ID NO: 69313 - DNA, 20 bp, Artificial Sequence
  sgRNA
  NTC_4566
ctcgggtgcgcgtctcgatg

SEQ ID NO: 69314 - DNA, 20 bp, Artificial Sequence
  sgRNA
  NTC_4567
acgatactatgccgcatctg

SEQ ID NO: 69315 - DNA, 20 bp, Artificial Sequence
  sgRNA
  NTC_4568
gtgcgggaacggtcgtatta

SEQ ID NO: 69316 - DNA, 20 bp, Artificial Sequence
  sgRNA
  NTC_4569
ggttacgcggtcttacgaca

SEQ ID NO: 69317 - DNA, 20 bp, Artificial Sequence
  sgRNA
  NTC_4570
cacgagacgaaccgtcattc

SEQ ID NO: 69318 - DNA, 20 bp, Artificial Sequence
  sgRNA
  NTC_4571
tcggcgtaatcgcgctgatc

SEQ ID NO: 69319 - DNA, 20 bp, Artificial Sequence
  sgRNA
  NTC_4572
cgcggacgtcagtatattcg

SEQ ID NO: 69320 - DNA, 20 bp, Artificial Sequence
  sgRNA
  NTC_4573
cacgaaacacggattacgac

SEQ ID NO: 69321 - DNA, 20 bp, Artificial Sequence
  sgRNA
  NTC_4574
aaatctgtagtcgcaacgta

SEQ ID NO: 69322 - DNA, 20 bp, Artificial Sequence
  sgRNA
  NTC_4575
ttatcgtggagtccgagtta

SEQ ID NO: 69323 - DNA, 20 bp, Artificial Sequence
  sgRNA
  NTC_4576
ggggcgaagcgtgccgttat

SEQ ID NO: 69324 - DNA, 20 bp, Artificial Sequence
  sgRNA
  NTC_4577
tcaacaaggtctcgcgtcgt

SEQ ID NO: 69325 - DNA, 20 bp, Artificial Sequence
  sgRNA
  NTC_4578
tcgtcgtcgttacatcgaga

SEQ ID NO: 69326 - DNA, 20 bp, Artificial Sequence
  sgRNA
  NTC_4579
ggtacgcgttactgtaccgc

SEQ ID NO: 69327 - DNA, 20 bp, Artificial Sequence
  sgRNA
  NTC_4580
tgaactcgacgcccgtagta

SEQ ID NO: 69328 - DNA, 20 bp, Artificial Sequence
  sgRNA
  NTC_4581
tcgagtacgtttgacgtccg

SEQ ID NO: 69329 - DNA, 20 bp, Artificial Sequence
  sgRNA
  NTC_4582
aagattaggcgcgccccgcg

SEQ ID NO: 69330 - DNA, 20 bp, Artificial Sequence
  sgRNA
  NTC_4583
acgtgcacgaggcgccgagc

SEQ ID NO: 69331 - DNA, 20 bp, Artificial Sequence
  sgRNA
  NTC_4584
tcactcataggcgacgttat

SEQ ID NO: 69332 - DNA, 20 bp, Artificial Sequence
  sgRNA
  NTC_4585
gatactaacggtcgtgcaac

SEQ ID NO: 69333 - DNA, 20 bp, Artificial Sequence
  sgRNA
  NTC_4586
aaagatagtcgacgcgccgt

SEQ ID NO: 69334 - DNA, 20 bp, Artificial Sequence
  sgRNA
  NTC_4587
ttcgacgctacaagccgagt

SEQ ID NO: 69335 - DNA, 20 bp, Artificial Sequence
  sgRNA
  NTC_4588
aacggtctagcattcgtacg

SEQ ID NO: 69336 - DNA, 20 bp, Artificial Sequence
  sgRNA
  NTC_4589
gttatagagcgtaccgcccg

SEQ ID NO: 69337 - DNA, 20 bp, Artificial Sequence
  sgRNA
  NTC_4590
ggtctaactcaacgcatcga

SEQ ID NO: 69338 - DNA, 20 bp, Artificial Sequence
  sgRNA
  NTC_4591
gtcgtcggtctaatcgagtc

SEQ ID NO: 69339 - DNA, 20 bp, Artificial Sequence
  sgRNA
  NTC_4592
ctacgcaatattatgcgccg

SEQ ID NO: 69340 - DNA, 20 bp, Artificial Sequence
  sgRNA
  NTC_4593
acgacgattacgcgagcgtc

SEQ ID NO: 69341 - DNA, 20 bp, Artificial Sequence
  sgRNA
  NTC_4594
ggtagtacgattccgacgtc

SEQ ID NO: 69342 - DNA, 20 bp, Artificial Sequence
  sgRNA
  NTC_4595
gactattcttcgcgacccta

SEQ ID NO: 69343 - DNA, 20 bp, Artificial Sequence
  sgRNA
  NTC_4596
gggcgtatggttacgacgag

SEQ ID NO: 69344 - DNA, 20 bp, Artificial Sequence
  sgRNA
  NTC_4597
gcgatcgtacgcgttaagac

SEQ ID NO: 69345 - DNA, 20 bp, Artificial Sequence
  sgRNA
  NTC_4598
tttaggcactgcgcccgttc

SEQ ID NO: 69346 - DNA, 20 bp, Artificial Sequence
  sgRNA
  NTC_4599
agtggggctgacgcgcctag

SEQ ID NO: 69347 - DNA, 20 bp, Artificial Sequence
  sgRNA
  NTC_4600
ggactcgaatttcgcaacgt

SEQ ID NO: 69348 - DNA, 20 bp, Artificial Sequence
  sgRNA
  NTC_4601
cagcactacggccgttccat

SEQ ID NO: 69349 - DNA, 20 bp, Artificial Sequence
  sgRNA
  NTC_4602
acatcgacgtgaagtgcgcc

SEQ ID NO: 69350 - DNA, 20 bp, Artificial Sequence
  sgRNA
  NTC_4603
tacgcggcgctatccaccac

SEQ ID NO: 69351 - DNA, 20 bp, Artificial Sequence
  sgRNA
  NTC_4604
gacgttgatctcgtgcgtta

SEQ ID NO: 69352 - DNA, 20 bp, Artificial Sequence
  sgRNA
  NTC_4605
ttgcgcgtgtagcgttacca

SEQ ID NO: 69353 - DNA, 20 bp, Artificial Sequence
  sgRNA
  NTC_4606
tgcggcaatagagcgcacgt

SEQ ID NO: 69354 - DNA, 20 bp, Artificial Sequence
  sgRNA
  NTC_4607
atgcgacatcgagcgcatat

SEQ ID NO: 69355 - DNA, 20 bp, Artificial Sequence
  sgRNA
  NTC_4608
ttcgatgctcaaacgatccg

SEQ ID NO: 69356 - DNA, 20 bp, Artificial Sequence
  sgRNA
  NTC_4609
tagtgaatacggatcgagcg

SEQ ID NO: 69357 - DNA, 20 bp, Artificial Sequence
  sgRNA
  NTC_4610
gcgaattaacggcgccgtgt

SEQ ID NO: 69358 - DNA, 20 bp, Artificial Sequence
  sgRNA
  NTC_4611
cggcatcattctacgacctt

SEQ ID NO: 69359 - DNA, 20 bp, Artificial Sequence
  sgRNA
  NTC_4612
atgtcgtaatatgacgcgat

SEQ ID NO: 69360 - DNA, 20 bp, Artificial Sequence
  sgRNA
  NTC_4613
gcgactttcgcgcacgaccc

SEQ ID NO: 69361 - DNA, 20 bp, Artificial Sequence
  sgRNA
  NTC_4614
acgtaatctctaacgaccgc

SEQ ID NO: 69362 - DNA, 20 bp, Artificial Sequence
  sgRNA
  NTC_4615
tgcttaaagtacgacacgat

SEQ ID NO: 69363 - DNA, 20 bp, Artificial Sequence
  sgRNA
  NTC_4616
gatcgggcgataacttagaa

SEQ ID NO: 69364 - DNA, 20 bp, Artificial Sequence
  sgRNA
  NTC_4617
tagtagcaacacgcgactcg

SEQ ID NO: 69365 - DNA, 20 bp, Artificial Sequence
  sgRNA
  NTC_4618
cacggcgcgactcttgcaat

SEQ ID NO: 69366 - DNA, 20 bp, Artificial Sequence
  sgRNA
  NTC_4619
ggatgtacgacgcgcataga

SEQ ID NO: 69367 - DNA, 20 bp, Artificial Sequence
  sgRNA
  NTC_4620
ttaggtcggcgctagattgc

SEQ ID NO: 69368 - DNA, 20 bp, Artificial Sequence
  sgRNA
  NTC_4621
gttcgtagattcgacgcatt

SEQ ID NO: 69369 - DNA, 20 bp, Artificial Sequence
  sgRNA
  NTC_4622
gcggtgtgcgtcgtgagcat

SEQ ID NO: 69370 - DNA, 20 bp, Artificial Sequence
  sgRNA
  NTC_4623
gtacgctaggctcgctaacg

SEQ ID NO: 69371 - DNA, 20 bp, Artificial Sequence
  sgRNA
  NTC_4624
gacggagtatcgtaccgttg

SEQ ID NO: 69372 - DNA, 20 bp, Artificial Sequence
  sgRNA
  NTC_4625
tctatatgttattcgcgtag

SEQ ID NO: 69373 - DNA, 20 bp, Artificial Sequence
  sgRNA
  NTC_4626
tttctacaacgatacgacta

SEQ ID NO: 69374 - DNA, 20 bp, Artificial Sequence
  sgRNA
  NTC_4627
gacggctaaagatgcgacga

SEQ ID NO: 69375 - DNA, 20 bp, Artificial Sequence
  sgRNA
  NTC_4628
gaagtgtcacgacgtgatct

SEQ ID NO: 69376 - DNA, 20 bp, Artificial Sequence
  sgRNA
  NTC_4629
tcacggttcgactattgcgc

SEQ ID NO: 69377 - DNA, 20 bp, Artificial Sequence
  sgRNA
  NTC_4630
ttcgtgttgcgcgacattat

SEQ ID NO: 69378 - DNA, 20 bp, Artificial Sequence
  sgRNA
  NTC_4631
cgaggggtcacgcgacgtgt

SEQ ID NO: 69379 - DNA, 20 bp, Artificial Sequence
  sgRNA
  NTC_4632
ctcgcgaaggagctcgtatc

SEQ ID NO: 69380 - DNA, 20 bp, Artificial Sequence
  sgRNA
  NTC_4633
attctacgcgttgattcgcg

SEQ ID NO: 69381 - DNA, 20 bp, Artificial Sequence
  sgRNA
  NTC_4634
ttagtcgcgcgacgcttaac

SEQ ID NO: 69382 - DNA, 20 bp, Artificial Sequence
  sgRNA
  NTC_4635
tgtgggagcaacgtcgtagt

SEQ ID NO: 69383 - DNA, 20 bp, Artificial Sequence
  sgRNA
  NTC_4636
cgcggtcgggcgtaattact

SEQ ID NO: 69384 - DNA, 20 bp, Artificial Sequence
  sgRNA
  NTC_4637
gcgctttatgagtacgcgcg

SEQ ID NO: 69385 - DNA, 20 bp, Artificial Sequence
  sgRNA
  NTC_4638
ggctataagtacgcgtgatt

SEQ ID NO: 69386 - DNA, 20 bp, Artificial Sequence
  sgRNA
  NTC_4639
gctgtatcgggatcgcgaat

SEQ ID NO: 69387 - DNA, 20 bp, Artificial Sequence
  sgRNA
  NTC_4640
gcgttggctttagcgaccta

SEQ ID NO: 69388 - DNA, 20 bp, Artificial Sequence
  sgRNA
  NTC_4641
gtatcgacggtgcatcgccg

SEQ ID NO: 69389 - DNA, 20 bp, Artificial Sequence
  sgRNA
  NTC_4642
tagcgcataactacgcgtat

SEQ ID NO: 69390 - DNA, 20 bp, Artificial Sequence
  sgRNA
  NTC_4643
gattctaacgtacgtgagct

SEQ ID NO: 69391 - DNA, 20 bp, Artificial Sequence
  sgRNA
  NTC_4644
gactatcaatcacgtcgatc

SEQ ID NO: 69392 - DNA, 20 bp, Artificial Sequence
  sgRNA
  NTC_4645
ggtgactacgcgacttatca

SEQ ID NO: 69393 - DNA, 20 bp, Artificial Sequence
  sgRNA
  NTC_4646
gtgcttaaggtgttcgatag

SEQ ID NO: 69394 - DNA, 20 bp, Artificial Sequence
  sgRNA
  NTC_4647
tactatgggtttcactcgcg

SEQ ID NO: 69395 - DNA, 20 bp, Artificial Sequence
  sgRNA
  NTC_4648
gacgcgcgcgttccatatag

SEQ ID NO: 69396 - DNA, 20 bp, Artificial Sequence
  sgRNA
  NTC_4649
ggctctaaatcgacgataca

SEQ ID NO: 69397 - DNA, 20 bp, Artificial Sequence
  sgRNA
  NTC_4650
cgtcgacttgtcattacgag

SEQ ID NO: 69398 - DNA, 20 bp, Artificial Sequence
  sgRNA
  NTC_4651
gtcgtcacgcggtagacttt

SEQ ID NO: 69399 - DNA, 20 bp, Artificial Sequence
  sgRNA
  NTC_4652
caatcgatcaactcgccgcg

SEQ ID NO: 69400 - DNA, 20 bp, Artificial Sequence
  sgRNA
  NTC_4653
cgacgctgcgtgtatcgtac

SEQ ID NO: 69401 - DNA, 20 bp, Artificial Sequence
  sgRNA
  NTC_4654
tgctggctcgacgtacgcta

SEQ ID NO: 69402 - DNA, 20 bp, Artificial Sequence
  sgRNA
  NTC_4655
gcatcaactcgtttgcgccc

SEQ ID NO: 69403 - DNA, 20 bp, Artificial Sequence
  sgRNA
  NTC_4656
cgtgtagtttacgaaacgcg

SEQ ID NO: 69404 - DNA, 20 bp, Artificial Sequence
  sgRNA
  NTC_4657
tcgtatttcggtgtcgacaa

SEQ ID NO: 69405 - DNA, 20 bp, Artificial Sequence
  sgRNA
  NTC_4658
cgtgacaatttatcgcgctc

SEQ ID NO: 69406 - DNA, 20 bp, Artificial Sequence
  sgRNA
  NTC_4659
tcatgcgcaacgtgcgactt

SEQ ID NO: 69407 - DNA, 20 bp, Artificial Sequence
  sgRNA
  NTC_4660
gtcgattgaatgagcgccta

SEQ ID NO: 69408 - DNA, 20 bp, Artificial Sequence
  sgRNA
  NTC_4661
cgcgtaatggcgacaacagt

SEQ ID NO: 69409 - DNA, 20 bp, Artificial Sequence
  sgRNA
  NTC_4662
atgtagcgttatagctcgtg

SEQ ID NO: 69410 - DNA, 20 bp, Artificial Sequence
  sgRNA
  NTC_4663
ctcgatcacgcactgcgtgt

SEQ ID NO: 69411 - DNA, 20 bp, Artificial Sequence
  sgRNA
  NTC_4664
gagtatagcgctacgagccg

SEQ ID NO: 69412 - DNA, 20 bp, Artificial Sequence
  sgRNA
  NTC_4665
gtcaggtgcagtcgacgaat

SEQ ID NO: 69413 - DNA, 20 bp, Artificial Sequence
  sgRNA
  NTC_4666
cgcgatactgtccgatcgac

SEQ ID NO: 69414 - DNA, 20 bp, Artificial Sequence
  sgRNA
  NTC_4667
tcgcgcgtaaacacgtatag

SEQ ID NO: 69415 - DNA, 20 bp, Artificial Sequence
  sgRNA
  NTC_4668
tcgataattactctcgtcgt

SEQ ID NO: 69416 - DNA, 20 bp, Artificial Sequence
  sgRNA
  NTC_4669
tagtgtcttacgttcgcaaa

SEQ ID NO: 69417 - DNA, 20 bp, Artificial Sequence
  sgRNA
  NTC_4670
ttcgacgtagtaacgtccgc

SEQ ID NO: 69418 - DNA, 20 bp, Artificial Sequence
  sgRNA
  NTC_4671
tatcggcgtgagcgcgtatc

SEQ ID NO: 69419 - DNA, 20 bp, Artificial Sequence
  sgRNA
  NTC_4672
gcgcgcaatttgccgcattg

SEQ ID NO: 69420 - DNA, 20 bp, Artificial Sequence
  sgRNA
  NTC_4673
atatgcgactctcgtcgcct

SEQ ID NO: 69421 - DNA, 20 bp, Artificial Sequence
  sgRNA
  NTC_4674
cgggtttcgcattgcgcctt

SEQ ID NO: 69422 - DNA, 20 bp, Artificial Sequence
  sgRNA
  NTC_4675
cactataatggtttcgacgt

SEQ ID NO: 69423 - DNA, 20 bp, Artificial Sequence
  sgRNA
  NTC_4676
cgcgatgaatatatcgatca

SEQ ID NO: 69424 - DNA, 20 bp, Artificial Sequence
  sgRNA
  NTC_4677
gcacagattcgctcgtagcg

SEQ ID NO: 69425 - DNA, 20 bp, Artificial Sequence
  sgRNA
  NTC_4678
gcttaatcgtcgtccgtatg

SEQ ID NO: 69426 - DNA, 20 bp, Artificial Sequence
  sgRNA
  NTC_4679
cgatactattgcgctccgac

SEQ ID NO: 69427 - DNA, 20 bp, Artificial Sequence
  sgRNA
  NTC_4680
atatggcaacacgacgctct

SEQ ID NO: 69428 - DNA, 20 bp, Artificial Sequence
  sgRNA
  NTC_4681
ggactcgtttacgactccgt

SEQ ID NO: 69429 - DNA, 20 bp, Artificial Sequence
  sgRNA
  NTC_4682
cggtgttcgacacgatctaa

SEQ ID NO: 69430 - DNA, 20 bp, Artificial Sequence
  sgRNA
  NTC_4683
gcgcaaaaattcgaccgtaa

SEQ ID NO: 69431 - DNA, 20 bp, Artificial Sequence
  sgRNA
  NTC_4684
cactcgttcagaccgcgaat

SEQ ID NO: 69432 - DNA, 20 bp, Artificial Sequence
  sgRNA
  NTC_4685
tgaattgttggacgcgaacc

SEQ ID NO: 69433 - DNA, 20 bp, Artificial Sequence
  sgRNA
  NTC_4686
tcggctcgtgtttaccgacg

SEQ ID NO: 69434 - DNA, 20 bp, Artificial Sequence
  sgRNA
  NTC_4687
tcatctgaacggtacgaacg

SEQ ID NO: 69435 - DNA, 20 bp, Artificial Sequence
  sgRNA
  NTC_4688
gcggtcatcgtgttcgcgat

SEQ ID NO: 69436 - DNA, 20 bp, Artificial Sequence
  sgRNA
  NTC_4689
cgactcgtgcattgcgatac

SEQ ID NO: 69437 - DNA, 20 bp, Artificial Sequence
  sgRNA
  NTC_4690
cggcgatcatacccataatg

SEQ ID NO: 69438 - DNA, 20 bp, Artificial Sequence
  sgRNA
  NTC_4691
cgatgtcaatgcgcgttgtg

SEQ ID NO: 69439 - DNA, 20 bp, Artificial Sequence
  sgRNA
  NTC_4692
cgcttggggacgcgtaaaga

SEQ ID NO: 69440 - DNA, 20 bp, Artificial Sequence
  sgRNA
  NTC_4693
ttagcggtcataactcgtat

SEQ ID NO: 69441 - DNA, 20 bp, Artificial Sequence
  sgRNA
  NTC_4694
tttgggggcgtcaacgccac

SEQ ID NO: 69442 - DNA, 20 bp, Artificial Sequence
  sgRNA
  NTC_4695
gcgtagctgattcgagatat

SEQ ID NO: 69443 - DNA, 20 bp, Artificial Sequence
  sgRNA
  NTC_4696
gcagtattgatcccgcacgt

SEQ ID NO: 69444 - DNA, 20 bp, Artificial Sequence
  sgRNA
  NTC_4697
aagcgacgcgttatgcctat

SEQ ID NO: 69445 - DNA, 20 bp, Artificial Sequence
  sgRNA
  NTC_4698
gtcgtgattatccacgaagt

SEQ ID NO: 69446 - DNA, 20 bp, Artificial Sequence
  sgRNA
  NTC_4699
tcgcgactgaatcgcgcttt

SEQ ID NO: 69447 - DNA, 20 bp, Artificial Sequence
  sgRNA
  NTC_4700
ctttatagcatccgcgagat

SEQ ID NO: 69448 - DNA, 20 bp, Artificial Sequence
  sgRNA
  NTC_4701
tgagcgttcggtgccgtacg

SEQ ID NO: 69449 - DNA, 20 bp, Artificial Sequence
  sgRNA
  NTC_4702
tgcgactaggcgttgagtcg

SEQ ID NO: 69450 - DNA, 20 bp, Artificial Sequence
  sgRNA
  NTC_4703
cggacaagtagagcgtcgta

SEQ ID NO: 69451 - DNA, 20 bp, Artificial Sequence
  sgRNA
  NTC_4704
acgagtcgtacgacgcactt

SEQ ID NO: 69452 - DNA, 20 bp, Artificial Sequence
  sgRNA
  NTC_4705
gatctcacgacgatcactac

SEQ ID NO: 69453 - DNA, 20 bp, Artificial Sequence
  sgRNA
  NTC_4706
cgctacgtcatgaagcgcgc

SEQ ID NO: 69454 - DNA, 20 bp, Artificial Sequence
  sgRNA
  NTC_4707
tctcgatcaaactcgtgatg

SEQ ID NO: 69455 - DNA, 20 bp, Artificial Sequence
  sgRNA
  NTC_4708
gagtgctttcagcgacgacg

SEQ ID NO: 69456 - DNA, 20 bp, Artificial Sequence
  sgRNA
  NTC_4709
agtggcgctcgcgccgtaaa

SEQ ID NO: 69457 - DNA, 20 bp, Artificial Sequence
  sgRNA
  NTC_4710
gatatgtggctcgaatgacg

SEQ ID NO: 69458 - DNA, 20 bp, Artificial Sequence
  sgRNA
  NTC_4711
actatgcggacacctcgtcg

SEQ ID NO: 69459 - DNA, 20 bp, Artificial Sequence
  sgRNA
  NTC_4712
acgaagctttcgcgataaat

SEQ ID NO: 69460 - DNA, 20 bp, Artificial Sequence
  sgRNA
  NTC_4713
tgagtgcgtcgaatcgattg

SEQ ID NO: 69461 - DNA, 20 bp, Artificial Sequence
  sgRNA
  NTC_4714
cgcgcacatcgatacgctat

SEQ ID NO: 69462 - DNA, 20 bp, Artificial Sequence
  sgRNA
  NTC_4715
ctcgttaagttcgtcgccgc

SEQ ID NO: 69463 - DNA, 20 bp, Artificial Sequence
  sgRNA
  NTC_4716
actagcaatgcttcgcgacc

SEQ ID NO: 69464 - DNA, 20 bp, Artificial Sequence
  sgRNA
  NTC_4717
cgactgtcggtacgccgttc

SEQ ID NO: 69465 - DNA, 20 bp, Artificial Sequence
  sgRNA
  NTC_4718
gcgctcgacatgcgccccat

SEQ ID NO: 69466 - DNA, 20 bp, Artificial Sequence
  sgRNA
  NTC_4719
cggctttgtcacgatacgtt

SEQ ID NO: 69467 - DNA, 20 bp, Artificial Sequence
  sgRNA
  NTC_4720
tggactgaacgcgcgaatac

SEQ ID NO: 69468 - DNA, 20 bp, Artificial Sequence
  sgRNA
  NTC_4721
cggaacgacgatgaagcgtc

SEQ ID NO: 69469 - DNA, 20 bp, Artificial Sequence
  sgRNA
  NTC_4722
cgacgggaggggtccgcaaa

SEQ ID NO: 69470 - DNA, 20 bp, Artificial Sequence
  sgRNA
  NTC_4723
gaggctttcggtatccgttc

SEQ ID NO: 69471 - DNA, 20 bp, Artificial Sequence
  sgRNA
  NTC_4724
ggcgcggagactagaatatt

SEQ ID NO: 69472 - DNA, 20 bp, Artificial Sequence
  sgRNA
  NTC_4725
tcgtatgcggagtccgctga

SEQ ID NO: 69473 - DNA, 20 bp, Artificial Sequence
  sgRNA
  NTC_4726
ggaacgtttgcgcgcgatgc

SEQ ID NO: 69474 - DNA, 20 bp, Artificial Sequence
  sgRNA
  NTC_4727
cggagtcgaagtacccgatt

SEQ ID NO: 69475 - DNA, 20 bp, Artificial Sequence
  sgRNA
  NTC_4728
gtgtggcggcacgcccaatc

SEQ ID NO: 69476 - DNA, 20 bp, Artificial Sequence
  sgRNA
  NTC_4729
cgtctatcaatatcgcgcga

SEQ ID NO: 69477 - DNA, 20 bp, Artificial Sequence
  sgRNA
  NTC_4730
atcgcgacttgtacgctttc

SEQ ID NO: 69478 - DNA, 20 bp, Artificial Sequence
  sgRNA
  NTC_4731
cacgtcgatagttgccaccg

SEQ ID NO: 69479 - DNA, 20 bp, Artificial Sequence
  sgRNA
  NTC_4732
tagacgtggagtcgcgctac

SEQ ID NO: 69480 - DNA, 20 bp, Artificial Sequence
  sgRNA
  NTC_4733
aggtcataaggccacgatcg

SEQ ID NO: 69481 - DNA, 20 bp, Artificial Sequence
  sgRNA
  NTC_4734
aacagcgctggacgcgaccg

SEQ ID NO: 69482 - DNA, 20 bp, Artificial Sequence
  sgRNA
  NTC_4735
ggcttaggcgctcgtcgaag

SEQ ID NO: 69483 - DNA, 20 bp, Artificial Sequence
  sgRNA
  NTC_4736
acgtatgggctgtcgatacg

SEQ ID NO: 69484 - DNA, 20 bp, Artificial Sequence
  sgRNA
  NTC_4737
gcggtggcgtattgcgcccc

SEQ ID NO: 69485 - DNA, 20 bp, Artificial Sequence
  sgRNA
  NTC_4738
atgggtacgacttacgtagt

SEQ ID NO: 69486 - DNA, 20 bp, Artificial Sequence
  sgRNA
  NTC_4739
cgcgttgctcgttcgcgcaa

SEQ ID NO: 69487 - DNA, 20 bp, Artificial Sequence
  sgRNA
  NTC_4740
aatgtgactcgagtcgtcgc

SEQ ID NO: 69488 - DNA, 20 bp, Artificial Sequence
  sgRNA
  NTC_4741
tttagctcgctaacgactcg

SEQ ID NO: 69489 - DNA, 20 bp, Artificial Sequence
  sgRNA
  NTC_4742
gtgcatgagcgatacaacgt

SEQ ID NO: 69490 - DNA, 20 bp, Artificial Sequence
  sgRNA
  NTC_4743
tgtcgaaggtgtcgcgtcga

SEQ ID NO: 69491 - DNA, 20 bp, Artificial Sequence
  sgRNA
  NTC_4744
atgacgcacggcactcgcta

SEQ ID NO: 69492 - DNA, 20 bp, Artificial Sequence
  sgRNA
  NTC_4745
aaacgacgatacagcgtacg

SEQ ID NO: 69493 - DNA, 20 bp, Artificial Sequence
  sgRNA
  NTC_4746
attggcggtcggcgtcgtag

SEQ ID NO: 69494 - DNA, 20 bp, Artificial Sequence
  sgRNA
  NTC_4747
gtcggtcggttgcgtaacat

SEQ ID NO: 69495 - DNA, 20 bp, Artificial Sequence
  sgRNA
  NTC_4748
atttggtaaagctccgcgca

SEQ ID NO: 69496 - DNA, 20 bp, Artificial Sequence
  sgRNA
  NTC_4749
tcgtattactaccgataccg

SEQ ID NO: 69497 - DNA, 20 bp, Artificial Sequence
  sgRNA
  NTC_4750
catcgcatcgaccgcgtcgc

SEQ ID NO: 69498 - DNA, 20 bp, Artificial Sequence
  sgRNA
  NTC_4751
agagttgcgtcaccgcgtta

SEQ ID NO: 69499 - DNA, 20 bp, Artificial Sequence
  sgRNA
  NTC_4752
gacgtcgggcgttatacaag

SEQ ID NO: 69500 - DNA, 20 bp, Artificial Sequence
  sgRNA
  NTC_4753
tgctaagacgcgtacgaccg

SEQ ID NO: 69501 - DNA, 20 bp, Artificial Sequence
  sgRNA
  NTC_4754
tcgtcaaggatctccgcgca

SEQ ID NO: 69502 - DNA, 20 bp, Artificial Sequence
  sgRNA
  NTC_4755
caacgtcagcgcccgacatc

SEQ ID NO: 69503 - DNA, 20 bp, Artificial Sequence
  sgRNA
  NTC_4756
gcgcgaatggtccgtcaatc

SEQ ID NO: 69504 - DNA, 20 bp, Artificial Sequence
  sgRNA
  NTC_4757
cgttcttagtcgttcgtaag

SEQ ID NO: 69505 - DNA, 20 bp, Artificial Sequence
  sgRNA
  NTC_4758
tcttgtggaggtcgcgtaat

SEQ ID NO: 69506 - DNA, 20 bp, Artificial Sequence
  sgRNA
  NTC_4759
tagttcgacgtgacaccgcg

SEQ ID NO: 69507 - DNA, 20 bp, Artificial Sequence
  sgRNA
  NTC_4760
tcgctcttcggaacgatagt

SEQ ID NO: 69508 - DNA, 20 bp, Artificial Sequence
  sgRNA
  NTC_4761
ttcagtgcgcacgaaacgtc

SEQ ID NO: 69509 - DNA, 20 bp, Artificial Sequence
  sgRNA
  NTC_4762
gcgtattagctgcgcttcga

SEQ ID NO: 69510 - DNA, 20 bp, Artificial Sequence
  sgRNA
  NTC_4763
ctacgacggcagctcgacgt

SEQ ID NO: 69511 - DNA, 20 bp, Artificial Sequence
  sgRNA
  NTC_4764
tcaaagttcggtccccgttg

SEQ ID NO: 69512 - DNA, 20 bp, Artificial Sequence
  sgRNA
  NTC_4765
tttgatcacgctttcgtacg

SEQ ID NO: 69513 - DNA, 20 bp, Artificial Sequence
  sgRNA
  NTC_4766
aaatcgtaagttccgtcata

SEQ ID NO: 69514 - DNA, 20 bp, Artificial Sequence
  sgRNA
  NTC_4767
atgctgagtgattcgcgcgc

SEQ ID NO: 69515 - DNA, 20 bp, Artificial Sequence
  sgRNA
  NTC_4768
gacggcgttatcctcgctta

SEQ ID NO: 69516 - DNA, 20 bp, Artificial Sequence
  sgRNA
  NTC_4769
gcataatgtacatcgcgttg

SEQ ID NO: 69517 - DNA, 20 bp, Artificial Sequence
  sgRNA
  NTC_4770
ctttgtacgacgcagtgcgc

SEQ ID NO: 69518 - DNA, 20 bp, Artificial Sequence
  sgRNA
  NTC_4771
tagcgagattagaccgacat

SEQ ID NO: 69519 - DNA, 20 bp, Artificial Sequence
  sgRNA
  NTC_4772
tatcggggctaaactaatat

SEQ ID NO: 69520 - DNA, 20 bp, Artificial Sequence
  sgRNA
  NTC_4773
aacagtgtagggcgattaac

SEQ ID NO: 69521 - DNA, 20 bp, Artificial Sequence
  sgRNA
  NTC_4774
ggtgactcgatacccgttta

SEQ ID NO: 69522 - DNA, 20 bp, Artificial Sequence
  sgRNA
  NTC_4775
gcgcacggcggactaatcca

SEQ ID NO: 69523 - DNA, 20 bp, Artificial Sequence
  sgRNA
  NTC_4776
tgggtcgactcgccccgtcc

SEQ ID NO: 69524 - DNA, 20 bp, Artificial Sequence
  sgRNA
  NTC_4777
tagcggttaatagtgcgacg

SEQ ID NO: 69525 - DNA, 20 bp, Artificial Sequence
  sgRNA
  NTC_4778
cgtggctaacgtcgtataac

SEQ ID NO: 69526 - DNA, 20 bp, Artificial Sequence
  sgRNA
  NTC_4779
cgctatgcaatatagagcgc

SEQ ID NO: 69527 - DNA, 20 bp, Artificial Sequence
  sgRNA
  NTC_4780
tgttggctcgatcgaattac

SEQ ID NO: 69528 - DNA, 20 bp, Artificial Sequence
  sgRNA
  NTC_4781
gtagacgcggcattcgacta

SEQ ID NO: 69529 - DNA, 20 bp, Artificial Sequence
  sgRNA
  NTC_4782
tgacggcacgttgcgctcgt

SEQ ID NO: 69530 - DNA, 20 bp, Artificial Sequence
  sgRNA
  NTC_4783
gtacagggtcgccgaattta

SEQ ID NO: 69531 - DNA, 20 bp, Artificial Sequence
  sgRNA
  NTC_4784
cgagtcgtgacacgttcagt

SEQ ID NO: 69532 - DNA, 20 bp, Artificial Sequence
  sgRNA
  NTC_4785
acttcatagatgaacgaccg

SEQ ID NO: 69533 - DNA, 20 bp, Artificial Sequence
  sgRNA
  NTC_4786
tgcaagcacgacaccgaccc

SEQ ID NO: 69534 - DNA, 20 bp, Artificial Sequence
  sgRNA
  NTC_4787
gggtaatcgtgcccagcgcg

SEQ ID NO: 69535 - DNA, 20 bp, Artificial Sequence
  sgRNA
  NTC_4788
agacttatttactgcgatcg

SEQ ID NO: 69536 - DNA, 20 bp, Artificial Sequence
  sgRNA
  NTC_4789
tctggcaatacacgcgcaac

SEQ ID NO: 69537 - DNA, 20 bp, Artificial Sequence
  sgRNA
  NTC_4790
acgctacgcggtatactagc

SEQ ID NO: 69538 - DNA, 20 bp, Artificial Sequence
  sgRNA
  NTC_4791
catagttaagcgcgagaatt

SEQ ID NO: 69539 - DNA, 20 bp, Artificial Sequence
  sgRNA
  NTC_4792
tctatggcttcgaacaatac

SEQ ID NO: 69540 - DNA, 20 bp, Artificial Sequence
  sgRNA
  NTC_4793
tacgtggtacgtcgaacgac

SEQ ID NO: 69541 - DNA, 20 bp, Artificial Sequence
  sgRNA
  NTC_4794
actaagttcgctcgcgtctg

SEQ ID NO: 69542 - DNA, 20 bp, Artificial Sequence
  sgRNA
  NTC_4795
cagttggcgcacgccaagta

SEQ ID NO: 69543 - DNA, 20 bp, Artificial Sequence
  sgRNA
  NTC_4796
gaggcgaagtgtagtccgtc

SEQ ID NO: 69544 - DNA, 20 bp, Artificial Sequence
  sgRNA
  NTC_4797
tgcgcaggctgacataacgt

SEQ ID NO: 69545 - DNA, 20 bp, Artificial Sequence
  sgRNA
  NTC_4798
cggcggtgtattatcgcgcg

SEQ ID NO: 69546 - DNA, 20 bp, Artificial Sequence
  sgRNA
  NTC_4799
aggcgacttcgtcacgtgtt

SEQ ID NO: 69547 - DNA, 20 bp, Artificial Sequence
  sgRNA
  NTC_4800
ggactgtattcgcacgaccg

SEQ ID NO: 69548 - DNA, 20 bp, Artificial Sequence
  sgRNA
  NTC_4801
acgcgcagattaacgattcg

SEQ ID NO: 69549 - DNA, 20 bp, Artificial Sequence
  sgRNA
  NTC_4802
gtacgttaatgtttcgctgt

SEQ ID NO: 69550 - DNA, 20 bp, Artificial Sequence
  sgRNA
  NTC_4803
agtagcgtaagagacgtagt

SEQ ID NO: 69551 - DNA, 20 bp, Artificial Sequence
  sgRNA
  NTC_4804
tctcgtactacgagtatctt

SEQ ID NO: 69552 - DNA, 20 bp, Artificial Sequence
  sgRNA
  NTC_4805
taataagcgggtacgattgc

SEQ ID NO: 69553 - DNA, 20 bp, Artificial Sequence
  sgRNA
  NTC_4806
aggcggactagtcgtgattc

SEQ ID NO: 69554 - DNA, 20 bp, Artificial Sequence
  sgRNA
  NTC_4807
tgcgaagaatcgcgacagcg

SEQ ID NO: 69555 - DNA, 20 bp, Artificial Sequence
  sgRNA
  NTC_4808
acaactacgagagttccgcg

SEQ ID NO: 69556 - DNA, 20 bp, Artificial Sequence
  sgRNA
  NTC_4809
cgcacgacgcatagatcgtt

SEQ ID NO: 69557 - DNA, 20 bp, Artificial Sequence
  sgRNA
  NTC_4810
ggttcgttgctcatcgcaac

SEQ ID NO: 69558 - DNA, 20 bp, Artificial Sequence
  sgRNA
  NTC_4811
tcgcaaacagtactcgtcgt

SEQ ID NO: 69559 - DNA, 20 bp, Artificial Sequence
  sgRNA
  NTC_4812
ttgtcgtcgaatgacacgcc

SEQ ID NO: 69560 - DNA, 20 bp, Artificial Sequence
  sgRNA
  NTC_4813
gtttcacacgagatcgacat

SEQ ID NO: 69561 - DNA, 20 bp, Artificial Sequence
  sgRNA
  NTC_4814
gaacgatcgttgtacgcctt

SEQ ID NO: 69562 - DNA, 20 bp, Artificial Sequence
  sgRNA
  NTC_4815
gcgcgcgactacgatcgcac

SEQ ID NO: 69563 - DNA, 20 bp, Artificial Sequence
  sgRNA
  NTC_4816
tcgtacatttcgcgcgtccg

SEQ ID NO: 69564 - DNA, 20 bp, Artificial Sequence
  sgRNA
  NTC_4817
tgacgcacaacgactccgcg

SEQ ID NO: 69565 - DNA, 20 bp, Artificial Sequence
  sgRNA
  NTC_4818
cagtataagtcgccgcgagt

SEQ ID NO: 69566 - DNA, 20 bp, Artificial Sequence
  sgRNA
  NTC_4819
tctcgctatgtcgcgacctt

SEQ ID NO: 69567 - DNA, 20 bp, Artificial Sequence
  sgRNA
  NTC_4820
ggaacgcgtagtcgcgcgta

SEQ ID NO: 69568 - DNA, 20 bp, Artificial Sequence
  sgRNA
  NTC_4821
tttgtaacgtaccacgacac

SEQ ID NO: 69569 - DNA, 20 bp, Artificial Sequence
  sgRNA
  NTC_4822
acgtgtagctcgccaatgta

SEQ ID NO: 69570 - DNA, 20 bp, Artificial Sequence
  sgRNA
  NTC_4823
aagttatggcgcgcaatacg

SEQ ID NO: 69571 - DNA, 20 bp, Artificial Sequence
  sgRNA
  NTC_4824
atgatcgtcgcgattgatca

SEQ ID NO: 69572 - DNA, 20 bp, Artificial Sequence
  sgRNA
  NTC_4825
aacgcattgttacccgaatt

SEQ ID NO: 69573 - DNA, 20 bp, Artificial Sequence
  sgRNA
  NTC_4826
atcgacgttcagcccgtatg

SEQ ID NO: 69574 - DNA, 20 bp, Artificial Sequence
  sgRNA
  NTC_4827
acgatcgggcgcatctacgt

SEQ ID NO: 69575 - DNA, 20 bp, Artificial Sequence
  sgRNA
  NTC_4828
gtggcgggtcaccgcacgtc

SEQ ID NO: 69576 - DNA, 20 bp, Artificial Sequence
  sgRNA
  NTC_4829
cacgcatcgctgctcgaata

SEQ ID NO: 69577 - DNA, 20 bp, Artificial Sequence
  sgRNA
  NTC_4830
gacacgcgcggaccaagatc

SEQ ID NO: 69578 - DNA, 20 bp, Artificial Sequence
  sgRNA
  NTC_4831
ggggcgactacacgatttaa

SEQ ID NO: 69579 - DNA, 20 bp, Artificial Sequence
  sgRNA
  NTC_4832
tggcgaaagcgacgtcgcac

SEQ ID NO: 69580 - DNA, 20 bp, Artificial Sequence
  sgRNA
  NTC_4833
attctctctagttacgccga

SEQ ID NO: 69581 - DNA, 20 bp, Artificial Sequence
  sgRNA
  NTC_4834
agtagacttacgagcgcacg

SEQ ID NO: 69582 - DNA, 20 bp, Artificial Sequence
  sgRNA
  NTC_4835
gtgcaggtatcgatacgtcc

SEQ ID NO: 69583 - DNA, 20 bp, Artificial Sequence
  sgRNA
  NTC_4836
gaatgcgtagtgcgtaccct

SEQ ID NO: 69584 - DNA, 20 bp, Artificial Sequence
  sgRNA
  NTC_4837
gagtggcggagcgacgtaac

SEQ ID NO: 69585 - DNA, 20 bp, Artificial Sequence
  sgRNA
  NTC_4838
tattcgagcagatcaacgtc

SEQ ID NO: 69586 - DNA, 20 bp, Artificial Sequence
  sgRNA
  NTC_4839
cattgtaacggacgcgcatt

SEQ ID NO: 69587 - DNA, 20 bp, Artificial Sequence
  sgRNA
  NTC_4840
gtacagggggcgcgcttgca

SEQ ID NO: 69588 - DNA, 20 bp, Artificial Sequence
  sgRNA
  NTC_4841
ggggatagcggtcgcgagta

SEQ ID NO: 69589 - DNA, 20 bp, Artificial Sequence
  sgRNA
  NTC_4842
ctcgatacgtgttcgcaaca

SEQ ID NO: 69590 - DNA, 20 bp, Artificial Sequence
  sgRNA
  NTC_4843
tcgacgacagcacccgacca

SEQ ID NO: 69591 - DNA, 20 bp, Artificial Sequence
  sgRNA
  NTC_4844
tctacgacgtaccgtaacag

SEQ ID NO: 69592 - DNA, 20 bp, Artificial Sequence
  sgRNA
  NTC_4845
ggtatgggcgggcctaatac

SEQ ID NO: 69593 - DNA, 20 bp, Artificial Sequence
  sgRNA
  NTC_4846
gggcgttcgcgtcctataaa

SEQ ID NO: 69594 - DNA, 20 bp, Artificial Sequence
  sgRNA
  NTC_4847
ggagtggggtaagtatcgac

SEQ ID NO: 69595 - DNA, 20 bp, Artificial Sequence
  sgRNA
  NTC_4848
aactacggaatgcacgactc

SEQ ID NO: 69596 - DNA, 20 bp, Artificial Sequence
  sgRNA
  NTC_4849
ttagggtaagcgctgaacgc

SEQ ID NO: 69597 - DNA, 20 bp, Artificial Sequence
  sgRNA
  NTC_4850
agcgctaagcgtcgtaattc

SEQ ID NO: 69598 - DNA, 20 bp, Artificial Sequence
  sgRNA
  NTC_4851
ttacgacggctcgtctccag

SEQ ID NO: 69599 - DNA, 20 bp, Artificial Sequence
  sgRNA
  NTC_4852
acagtctacgtgcacgtaat

SEQ ID NO: 69600 - DNA, 20 bp, Artificial Sequence
  sgRNA
  NTC_4853
ggagtggcggggcgttgttc

SEQ ID NO: 69601 - DNA, 20 bp, Artificial Sequence
  sgRNA
  NTC_4854
gcacgagtgggttcgattcg

SEQ ID NO: 69602 - DNA, 20 bp, Artificial Sequence
  sgRNA
  NTC_4855
cggcagactatgacgtacat

SEQ ID NO: 69603 - DNA, 20 bp, Artificial Sequence
  sgRNA
  NTC_4856
ggcattatcgctcgaacgtg

SEQ ID NO: 69604 - DNA, 20 bp, Artificial Sequence
  sgRNA
  NTC_4857
agtatcgaactgactgcgcg

SEQ ID NO: 69605 - DNA, 20 bp, Artificial Sequence
  sgRNA
  NTC_4858
ggcggttgtaaacgaacgcc

SEQ ID NO: 69606 - DNA, 20 bp, Artificial Sequence
  sgRNA
  NTC_4859
tcgattcgggcacgctagcg

SEQ ID NO: 69607 - DNA, 20 bp, Artificial Sequence
  sgRNA
  NTC_4860
ctttcgcggatgtatcgccg

SEQ ID NO: 69608 - DNA, 20 bp, Artificial Sequence
  sgRNA
  NTC_4861
gctcattacgaattaccgcc

SEQ ID NO: 69609 - DNA, 20 bp, Artificial Sequence
  sgRNA
  NTC_4862
gcgtcacggtctcgataacg

SEQ ID NO: 69610 - DNA, 20 bp, Artificial Sequence
  sgRNA
  NTC_4863
tacggtagttagacgtaacg

SEQ ID NO: 69611 - DNA, 20 bp, Artificial Sequence
  sgRNA
  NTC_4864
tcgtagcactcgagcgtagc

SEQ ID NO: 69612 - DNA, 20 bp, Artificial Sequence
  sgRNA
  NTC_4865
ttatgcgtaactcgcgaccg

SEQ ID NO: 69613 - DNA, 20 bp, Artificial Sequence
  sgRNA
  NTC_4866
agtgtggtcgatacgcgagc

SEQ ID NO: 69614 - DNA, 20 bp, Artificial Sequence
  sgRNA
  NTC_4867
gttaaaaacgtccgacacgc

SEQ ID NO: 69615 - DNA, 20 bp, Artificial Sequence
  sgRNA
  NTC_4868
cggtcaacggcgcgccacaa

SEQ ID NO: 69616 - DNA, 20 bp, Artificial Sequence
  sgRNA
  NTC_4869
ttacaaggctacgacgttcg

SEQ ID NO: 69617 - DNA, 20 bp, Artificial Sequence
  sgRNA
  NTC_4870
agtatcgcgtgtgcgtagat

SEQ ID NO: 69618 - DNA, 20 bp, Artificial Sequence
  sgRNA
  NTC_4871
aacggtactcgtcgtgatat

SEQ ID NO: 69619 - DNA, 20 bp, Artificial Sequence
  sgRNA
  NTC_4872
cgtctcgcagtcgaccccac

SEQ ID NO: 69620 - DNA, 20 bp, Artificial Sequence
  sgRNA
  NTC_4873
tgcaggatcgtgatcgattg

SEQ ID NO: 69621 - DNA, 20 bp, Artificial Sequence
  sgRNA
  NTC_4874
tcatcggcgaatgagcgatc

SEQ ID NO: 69622 - DNA, 20 bp, Artificial Sequence
  sgRNA
  NTC_4875
ggatataagtaccgcgctat

SEQ ID NO: 69623 - DNA, 20 bp, Artificial Sequence
  sgRNA
  NTC_4876
agggctcggtatatcgttac

SEQ ID NO: 69624 - DNA, 20 bp, Artificial Sequence
  sgRNA
  NTC_4877
acgcggtgtatcaatcgcga

SEQ ID NO: 69625 - DNA, 20 bp, Artificial Sequence
  sgRNA
  NTC_4878
atagattcgtgcctcgtaga

SEQ ID NO: 69626 - DNA, 20 bp, Artificial Sequence
  sgRNA
  NTC_4879
tagcacggatcgcgatagta

SEQ ID NO: 69627 - DNA, 20 bp, Artificial Sequence
  sgRNA
  NTC_4880
aggtgtcatcgtgtcgcaca

SEQ ID NO: 69628 - DNA, 20 bp, Artificial Sequence
  sgRNA
  NTC_4881
tcgtgaagatttactacgcg

SEQ ID NO: 69629 - DNA, 20 bp, Artificial Sequence
  sgRNA
  NTC_4882
cgcgatcgcagaaacgataa

SEQ ID NO: 69630 - DNA, 20 bp, Artificial Sequence
  sgRNA
  NTC_4883
gtcgagggcgttcgatccaa

SEQ ID NO: 69631 - DNA, 20 bp, Artificial Sequence
  sgRNA
  NTC_4884
cgacggcacgcaaaatgatg

SEQ ID NO: 69632 - DNA, 20 bp, Artificial Sequence
  sgRNA
  NTC_4885
actaactcgaggcgtcaacg

SEQ ID NO: 69633 - DNA, 20 bp, Artificial Sequence
  sgRNA
  NTC_4886
gctgcgcgctatgattccga

SEQ ID NO: 69634 - DNA, 20 bp, Artificial Sequence
  sgRNA
  NTC_4887
ctcacaagtctcaacgcgta

SEQ ID NO: 69635 - DNA, 20 bp, Artificial Sequence
  sgRNA
  NTC_4888
atacagcagtcgaacgatcg

SEQ ID NO: 69636 - DNA, 20 bp, Artificial Sequence
  sgRNA
  NTC_4889
tgcggggttgcgtccgcgac

SEQ ID NO: 69637 - DNA, 20 bp, Artificial Sequence
  sgRNA
  NTC_4890
gcggcgtctctacacacgcg

SEQ ID NO: 69638 - DNA, 20 bp, Artificial Sequence
  sgRNA
  NTC_4891
tggagacagctagccgtcga

SEQ ID NO: 69639 - DNA, 20 bp, Artificial Sequence
  sgRNA
  NTC_4892
agattcatcgatgtcgaccc

SEQ ID NO: 69640 - DNA, 20 bp, Artificial Sequence
  sgRNA
  NTC_4893
aataatgcttcacgcgatac

SEQ ID NO: 69641 - DNA, 20 bp, Artificial Sequence
  sgRNA
  NTC_4894
tatgcttatttagccgccgt

SEQ ID NO: 69642 - DNA, 20 bp, Artificial Sequence
  sgRNA
  NTC_4895
cggtggcgtaagacgatagc

SEQ ID NO: 69643 - DNA, 20 bp, Artificial Sequence
  sgRNA
  NTC_4896
attatggtggtcaatacgcc

SEQ ID NO: 69644 - DNA, 20 bp, Artificial Sequence
  sgRNA
  NTC_4897
aaagtagtcgtcgccgagca

SEQ ID NO: 69645 - DNA, 20 bp, Artificial Sequence
  sgRNA
  NTC_4898
tctcatgtctcgacatgcgt

SEQ ID NO: 69646 - DNA, 20 bp, Artificial Sequence
  sgRNA
  NTC_4899
ctgctacgtacgcgacgtca

SEQ ID NO: 69647 - DNA, 20 bp, Artificial Sequence
  sgRNA
  NTC_4900
aacgcgttgatccgtcataa

SEQ ID NO: 69648 - DNA, 20 bp, Artificial Sequence
  sgRNA
  NTC_4901
ttaacgaacggatcgactat

SEQ ID NO: 69649 - DNA, 20 bp, Artificial Sequence
  sgRNA
  NTC_4902
gacgtctcggctcgtcgtcg

SEQ ID NO: 69650 - DNA, 20 bp, Artificial Sequence
  sgRNA
  NTC_4903
gtagtatcacgcaatacgcc

SEQ ID NO: 69651 - DNA, 20 bp, Artificial Sequence
  sgRNA
  NTC_4904
gctacttcttctcgcgctta

SEQ ID NO: 69652 - DNA, 20 bp, Artificial Sequence
  sgRNA
  NTC_4905
gcgtgctcgtagttagtgaa

SEQ ID NO: 69653 - DNA, 20 bp, Artificial Sequence
  sgRNA
  NTC_4906
cggcgtcgattcgatcgact

SEQ ID NO: 69654 - DNA, 20 bp, Artificial Sequence
  sgRNA
  NTC_4907
tcggtggtagaacgcgagac

SEQ ID NO: 69655 - DNA, 20 bp, Artificial Sequence
  sgRNA
  NTC_4908
atgagttaattcccgacgcc

SEQ ID NO: 69656 - DNA, 20 bp, Artificial Sequence
  sgRNA
  NTC_4909
aggttagggggccgtaccct

SEQ ID NO: 69657 - DNA, 20 bp, Artificial Sequence
  sgRNA
  NTC_4910
agcgcgtaggggcgctcaat

SEQ ID NO: 69658 - DNA, 20 bp, Artificial Sequence
  sgRNA
  NTC_4911
atttactggacgcgaacaac

SEQ ID NO: 69659 - DNA, 20 bp, Artificial Sequence
  sgRNA
  NTC_4912
gatcgacagatcagcgcgaa

SEQ ID NO: 69660 - DNA, 20 bp, Artificial Sequence
  sgRNA
  NTC_4913
ggtataaacaacgtcgcaat

SEQ ID NO: 69661 - DNA, 20 bp, Artificial Sequence
  sgRNA
  NTC_4914
atctcggtataatcgcccgc

SEQ ID NO: 69662 - DNA, 20 bp, Artificial Sequence
  sgRNA
  NTC_4915
ttcagctggcaccgcgatat

SEQ ID NO: 69663 - DNA, 20 bp, Artificial Sequence
  sgRNA
  NTC_4916
cggttgcgtgtcttcgactt

SEQ ID NO: 69664 - DNA, 20 bp, Artificial Sequence
  sgRNA
  NTC_4917
gagcgactgttaaccgcttc

SEQ ID NO: 69665 - DNA, 20 bp, Artificial Sequence
  sgRNA
  NTC_4918
caactgacttgcgtgcaccg

SEQ ID NO: 69666 - DNA, 20 bp, Artificial Sequence
  sgRNA
  NTC_4919
taggcgtacgatgccgatca

SEQ ID NO: 69667 - DNA, 20 bp, Artificial Sequence
  sgRNA
  NTC_4920
ggtcggcgtcgcgtagacgc

SEQ ID NO: 69668 - DNA, 20 bp, Artificial Sequence
  sgRNA
  NTC_4921
actgacgtctgttgcgatcg

SEQ ID NO: 69669 - DNA, 20 bp, Artificial Sequence
  sgRNA
  NTC_4922
cacgtgtcatatacgtcgtc

SEQ ID NO: 69670 - DNA, 20 bp, Artificial Sequence
  sgRNA
  NTC_4923
ggggggcaagatttacgcca

SEQ ID NO: 69671 - DNA, 20 bp, Artificial Sequence
  sgRNA
  NTC_4924
actctagtactgttcgacgt

SEQ ID NO: 69672 - DNA, 20 bp, Artificial Sequence
  sgRNA
  NTC_4925
ggaagatactggtaatcgcg

SEQ ID NO: 69673 - DNA, 20 bp, Artificial Sequence
  sgRNA
  NTC_4926
tatctcttgtcgctcgcacg

SEQ ID NO: 69674 - DNA, 20 bp, Artificial Sequence
  sgRNA
  NTC_4927
gacatacgggttaagtcgat

SEQ ID NO: 69675 - DNA, 20 bp, Artificial Sequence
  sgRNA
  NTC_4928
aatctctcgatacaaccgcc

SEQ ID NO: 69676 - DNA, 20 bp, Artificial Sequence
  sgRNA
  NTC_4929
ttgcgaggtcgtaacctcac

SEQ ID NO: 69677 - DNA, 20 bp, Artificial Sequence
  sgRNA
  NTC_4930
ttaaaacgtacgccgttcca

SEQ ID NO: 69678 - DNA, 20 bp, Artificial Sequence
  sgRNA
  NTC_4931
cgcgtcgatttactaacacg

SEQ ID NO: 69679 - DNA, 20 bp, Artificial Sequence
  sgRNA
  NTC_4932
cgttgacgcaacctctaacg

SEQ ID NO: 69680 - DNA, 20 bp, Artificial Sequence
  sgRNA
  NTC_4933
gtggggtatgctcgcgaact

SEQ ID NO: 69681 - DNA, 20 bp, Artificial Sequence
  sgRNA
  NTC_4934
attggtcgcgctagccgtcg

SEQ ID NO: 69682 - DNA, 20 bp, Artificial Sequence
  sgRNA
  NTC_4935
gtgcgaagtacgaccagata

SEQ ID NO: 69683 - DNA, 20 bp, Artificial Sequence
  sgRNA
  NTC_4936
gtatggtcgaatgcgacgta

SEQ ID NO: 69684 - DNA, 20 bp, Artificial Sequence
  sgRNA
  NTC_4937
cgcgtgtatcagagcgatag

SEQ ID NO: 69685 - DNA, 20 bp, Artificial Sequence
  sgRNA
  NTC_4938
cgcgttgaagtacgccaatc

SEQ ID NO: 69686 - DNA, 20 bp, Artificial Sequence
  sgRNA
  NTC_4939
gcataaaatcgccgcaacga

SEQ ID NO: 69687 - DNA, 20 bp, Artificial Sequence
  sgRNA
  NTC_4940
acgcaagatcataacgaccg

SEQ ID NO: 69688 - DNA, 20 bp, Artificial Sequence
  sgRNA
  NTC_4941
ttacgtatggttcgtcgcac

SEQ ID NO: 69689 - DNA, 20 bp, Artificial Sequence
  sgRNA
  NTC_4942
aagacggtgcagaacgcgac

SEQ ID NO: 69690 - DNA, 20 bp, Artificial Sequence
  sgRNA
  NTC_4943
atgctgtacgaccgcaagtt

SEQ ID NO: 69691 - DNA, 20 bp, Artificial Sequence
  sgRNA
  NTC_4944
gcatctttaagcgtgcgtcg

SEQ ID NO: 69692 - DNA, 20 bp, Artificial Sequence
  sgRNA
  NTC_4945
aactgggtacgtgtagcgtc

SEQ ID NO: 69693 - DNA, 20 bp, Artificial Sequence
  sgRNA
  NTC_4946
gatgcgatgggtcaccgacc

SEQ ID NO: 69694 - DNA, 20 bp, Artificial Sequence
  sgRNA
  NTC_4947
cgttatatcgaacgaacccg

SEQ ID NO: 69695 - DNA, 20 bp, Artificial Sequence
  sgRNA
  NTC_4948
taaactaattgatgcgacgt

SEQ ID NO: 69696 - DNA, 20 bp, Artificial Sequence
  sgRNA
  NTC_4949
taagtttaaacgagccgtgt

SEQ ID NO: 69697 - DNA, 20 bp, Artificial Sequence
  sgRNA
  NTC_4950
cggctaacgatgacgttgtg

SEQ ID NO: 69698 - DNA, 20 bp, Artificial Sequence
  sgRNA
  NTC_4951
ctatgagtataaccgcccgc

SEQ ID NO: 69699 - DNA, 20 bp, Artificial Sequence
  sgRNA
  NTC_4952
cgactggttcgtacgacctg

SEQ ID NO: 69700 - DNA, 20 bp, Artificial Sequence
  sgRNA
  NTC_4953
caacaacgcgctttgacgta

SEQ ID NO: 69701 - DNA, 20 bp, Artificial Sequence
  sgRNA
  NTC_4954
atataagttcgccctaccgc

SEQ ID NO: 69702 - DNA, 20 bp, Artificial Sequence
  sgRNA
  NTC_4955
cactcaaggtacataacgac

SEQ ID NO: 69703 - DNA, 20 bp, Artificial Sequence
  sgRNA
  NTC_4956
ctagacacgctacgtgacat

SEQ ID NO: 69704 - DNA, 20 bp, Artificial Sequence
  sgRNA
  NTC_4957
gtcggtcgcttgccgctaca

SEQ ID NO: 69705 - DNA, 20 bp, Artificial Sequence
  sgRNA
  NTC_4958
atactcttcgcacgattaac

SEQ ID NO: 69706 - DNA, 20 bp, Artificial Sequence
  sgRNA
  NTC_4959
gtcgactgacgccaagcgcc

SEQ ID NO: 69707 - DNA, 20 bp, Artificial Sequence
  sgRNA
  NTC_4960
ggcgcggcgtacctctctat

SEQ ID NO: 69708 - DNA, 20 bp, Artificial Sequence
  sgRNA
  NTC_4961
cacggtagatgattacgtat

SEQ ID NO: 69709 - DNA, 20 bp, Artificial Sequence
  sgRNA
  NTC_4962
attcggcacgttgcacgata

SEQ ID NO: 69710 - DNA, 20 bp, Artificial Sequence
  sgRNA
  NTC_4963
tcaaatacgtttgtcgcgtg

SEQ ID NO: 69711 - DNA, 20 bp, Artificial Sequence
  sgRNA
  NTC_4964
tacgcggtgcgcgagactac

SEQ ID NO: 69712 - DNA, 20 bp, Artificial Sequence
  sgRNA
  NTC_4965
cagaatatctgacgcgcgct

SEQ ID NO: 69713 - DNA, 20 bp, Artificial Sequence
  sgRNA
  NTC_4966
gtttcaggcgtcgctcgcca

SEQ ID NO: 69714 - DNA, 20 bp, Artificial Sequence
  sgRNA
  NTC_4967
atcgtggtgtcttcgtacgc

SEQ ID NO: 69715 - DNA, 20 bp, Artificial Sequence
  sgRNA
  NTC_4968
tcgcgttaaacgctagcgtc

SEQ ID NO: 69716 - DNA, 20 bp, Artificial Sequence
  sgRNA
  NTC_4969
cacacgtcggtcagcccgtt

SEQ ID NO: 69717 - DNA, 20 bp, Artificial Sequence
  sgRNA
  NTC_4970
gcgttgcataaccgacgcgc

SEQ ID NO: 69718 - DNA, 20 bp, Artificial Sequence
  sgRNA
  NTC_4971
cttatcatgacgtatcgcca

SEQ ID NO: 69719 - DNA, 20 bp, Artificial Sequence
  sgRNA
  NTC_4972
tgacgataggagtgcgtacc

SEQ ID NO: 69720 - DNA, 20 bp, Artificial Sequence
  sgRNA
  NTC_4973
taaatagggtggtcgcccga

SEQ ID NO: 69721 - DNA, 20 bp, Artificial Sequence
  sgRNA
  NTC_4974
aggggcggatacgtaccgct

SEQ ID NO: 69722 - DNA, 20 bp, Artificial Sequence
  sgRNA
  NTC_4975
agtcggtcgttatgcgatat

SEQ ID NO: 69723 - DNA, 20 bp, Artificial Sequence
  sgRNA
  NTC_4976
taattctcgcatagtgcgct

SEQ ID NO: 69724 - DNA, 20 bp, Artificial Sequence
  sgRNA
  NTC_4977
cagacgggtcaccgccaatt

SEQ ID NO: 69725 - DNA, 20 bp, Artificial Sequence
  sgRNA
  NTC_4978
cttagcggcgcgacgtgttc

SEQ ID NO: 69726 - DNA, 20 bp, Artificial Sequence
  sgRNA
  NTC_4979
cggcgtctatcgctcaacgc

SEQ ID NO: 69727 - DNA, 20 bp, Artificial Sequence
  sgRNA
  NTC_4980
tttctaagtgcgacgtgacc

SEQ ID NO: 69728 - DNA, 20 bp, Artificial Sequence
  sgRNA
  NTC_4981
gggtggcaatacatcgcgac

SEQ ID NO: 69729 - DNA, 20 bp, Artificial Sequence
  sgRNA
  NTC_4982
tcgtgcgtcggtttaacgct

SEQ ID NO: 69730 - DNA, 20 bp, Artificial Sequence
  sgRNA
  NTC_4983
atatcgtacgctccatcgcg

SEQ ID NO: 69731 - DNA, 20 bp, Artificial Sequence
  sgRNA
  NTC_4984
tcgctggcactcgttgcgtt

SEQ ID NO: 69732 - DNA, 20 bp, Artificial Sequence
  sgRNA
  NTC_4985
ggtagtacagcaaccgatcg

SEQ ID NO: 69733 - DNA, 20 bp, Artificial Sequence
  sgRNA
  NTC_4986
actacgcgttaccgatacga

SEQ ID NO: 69734 - DNA, 20 bp, Artificial Sequence
  sgRNA
  NTC_4987
tgcgatgatcacgcattaag

SEQ ID NO: 69735 - DNA, 20 bp, Artificial Sequence
  sgRNA
  NTC_4988
ataatcgcgcgccgagcaag

SEQ ID NO: 69736 - DNA, 20 bp, Artificial Sequence
  sgRNA
  NTC_4989
cttcgggacgcgtccaccga

SEQ ID NO: 69737 - DNA, 20 bp, Artificial Sequence
  sgRNA
  NTC_4990
agatggacgatagtacgcgt

SEQ ID NO: 69738 - DNA, 20 bp, Artificial Sequence
  sgRNA
  NTC_4991
atcaggattaagttcgatca

SEQ ID NO: 69739 - DNA, 20 bp, Artificial Sequence
  sgRNA
  NTC_4992
cgctactttagatcgcgtaa

SEQ ID NO: 69740 - DNA, 20 bp, Artificial Sequence
  sgRNA
  NTC_4993
cgtgtctagcggagcgaaag

SEQ ID NO: 69741 - DNA, 20 bp, Artificial Sequence
  sgRNA
  NTC_4994
ttaatcggacttatcgtaga

SEQ ID NO: 69742 - DNA, 20 bp, Artificial Sequence
  sgRNA
  NTC_4995
atgcgtcgaggtcgaaccgc

SEQ ID NO: 69743 - DNA, 20 bp, Artificial Sequence
  sgRNA
  NTC_4996
cgcttcacgcgtcgtactgc

SEQ ID NO: 69744 - DNA, 20 bp, Artificial Sequence
  sgRNA
  NTC_4997
tggctcgacacgaccgtcgc

SEQ ID NO: 69745 - DNA, 20 bp, Artificial Sequence
  sgRNA
  NTC_4998
gtagtcgcgtacttctattc

SEQ ID NO: 69746 - DNA, 20 bp, Artificial Sequence
  sgRNA
  NTC_4999
taatcggaaactatcgagat

SEQ ID NO: 69747 - DNA, 20 bp, Artificial Sequence
  sgRNA
  NTC_5000
aacgtgctaaagcccgccgt

SEQ ID NO: 69748 - DNA, 7924 bp, Artificial Sequence
  Plasmid
  Lenti-EGFRvIII
gtgccacctgcagcctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccctgcccagggaccaccgacccaccaccgggaggcaagctggccagcaacttatctgtgtctgtccgattgtctagtgtctatgactgattttatgcgcctgcgtcggtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggccggatcccagtgtggtggtacatcatgcgaccctccgggacggccggggcagcgctcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcaactcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgagatgtaggaattcgccagcacagtggtcgaccctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgataaaataaaagattttatttagtctccagaaaaaggggggaatgaaagaccccacctgtaggtttggcaagctagcttaagtaacgccattttgcaaggcatggaaaaatacataactgagaatagagaagttcagatcaaggtcaggaacagatggaacagctgaatatgggccaaacaggatatctgtggtaagcagttcctgccccggctcagggccaagaacagatggaacagctgaatatgggccaaacaggatatctgtggtaagcagttcctgccccggctcagggccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccagtcctccgattgactgagtcgcccgggtacccgtgtatccaataaaccctcttgcagttgcatccgacttgtggtctcgctgttccttgggagggtctcctctgagtgattgactacccgtcagcgggggtctttcacatgcagcatgtatcaaaattaatttggttttttttcttaagtatttacattaaatggccatagttgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgcggccgcaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaa

SEQ ID NO: 69749 - DNA, 5826 bp, Artificial Sequence
  Plasmid
  EGFRvIII CAR
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgtgaccactccagatttcaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccgtcacgagcagctggtttctaatatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgacccctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagacgtacggccaccatggttctgctggtcaccagcctactactgtgcgaactgccccaccccgcctttctgctgatccccgacatccagatgacccagagccctagcagcctgagcgccagcgtgggcgacagagtgaccatcacctgtcgagccagccagggcatcagaaacaacctggcctggtatcagcagaagccaggcaaggccccaaagagactgatctacgctgccagcaatctgcagagcggcgtgccaagcagattcaccggaagcggctccggcaccgagttcaccctgatcgtgtccagcctgcagcccgaggacttcgccacctactactgcctgcagcaccacagctaccctctgaccagcggcggaggcaccaaggtggagatcaagcgaaccggaagcaccagcggaagcggcaagcctggcagcggagaaggaagcgaggtccaggtgctggaatctggcggcggactggtgcagcctggcggcagcctgagactgagctgtgccgccagcggcttcaccttcagcagctacgccatgtcttgggtccggcaggctcctggaaagggcctggaatgggtgtccgccatcagcggctctggcggctccaccaactacgccgacagcgtgaagggccggttcaccatcagccgggacaacagcaagaacaccctgtatctgcagatgaacagcctgagagccgaggacaccgccgtgtattattgtgccggcagcagcgggtggagcgagtactggggacagggcacactggtcacagtgtctagcgcggccgcactcgagaccacgacaccagcgccacgaccaccaacaccggcgccaaccatcgcgtcgcagccactgtccctgcgcccagaagcatgccgaccagcagcaggaggagcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagctagcaataaaagatctttattttcattagatctgtgtgttggttttttgtgtggtaccgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaaaacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacggaaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 69750 - DNA, 23 bp, Artificial Sequence
  Indel
  Fig 1G sgMgat5
cctcgtttaccttggagagcaaa

SEQ ID NO: 69751 - DNA, 35 bp, Artificial Sequence
  Indel
  Fig 1G sgMgat5 WT
ttggtgtcctcgtttaccttggagagcaaaaaatc

SEQ ID NO: 69752 - DNA, 34 bp, Artificial Sequence
  Indel
  Fig 1G sgMgat5 Indel
ttggtgtcctcgttaccttggagagcaaaaaatc

SEQ ID NO: 69753 - DNA, 36 bp, Artificial Sequence
  Indel
  Fig 1G sgMgat5 Indel
ttggtgtcctcgttttaccttggagagcaaaaaatc

SEQ ID NO: 69754 - DNA, 26 bp, Artificial Sequence
  Indel
  Fig 1G sgMgat5 Indel
ttggtgtccttggagagcaaaaaatc

SEQ ID NO: 69755 - DNA, 20 bp, Artificial Sequence
  Indel
  Fig 1G sgMgat5 Indel
accttggagagcaaaaaatc

SEQ ID NO: 69756 - DNA, 33 bp, Artificial Sequence
  Indel
  Fig 1G sgMgat5 Indel
ttggtgtcctcgttccttggagagcaaaaaatc

SEQ ID NO: 69757 - DNA, 34 bp, Artificial Sequence
  Indel
  Fig 1G sgMgat5 Indel
ttggtgtcctctttaccttggagagcaaaaaatc

SEQ ID NO: 69758 - DNA, 32 bp, Artificial Sequence
  Indel
  Fig 1G sgMgat5 Indel
ttggtgtcctcgttcttggagagcaaaaaatc

SEQ ID NO: 69759 - DNA, 23 bp, Artificial Sequence
  Indel
  Fig 1G sgPdia3
aaacacctgtaataagtatgggg

SEQ ID NO: 69760 - DNA, 35 bp, Artificial Sequence
  Indel
  Fig 1G sgPdia3 WT
aacacaaacacctgtaataagtatggggtcagtgg

SEQ ID NO: 69761 - DNA, 36 bp, Artificial Sequence
  Indel
  Fig 1G sgPdia3 Indel
aacacaaacacctgtaataagttatggggtcagtgg

SEQ ID NO: 69762 - DNA, 34 bp, Artificial Sequence
  Indel
  Fig 1G sgPdia3 Indel
aacacaaacacctgtaataatatggggtcagtgg

SEQ ID NO: 69763 - DNA, 33 bp, Artificial Sequence
  Indel
  Fig 1G sgPdia3 Indel
aacacaaacacctgtaataagtggggtcagtgg

SEQ ID NO: 69764 - DNA, 31 bp, Artificial Sequence
  Indel
  Fig 1G sgPdia3 Indel
aacacaaacacctgtaatatggggtcagtgg

SEQ ID NO: 69765 - DNA, 34 bp, Artificial Sequence
  Indel
  Fig 1G sgPdia3 Indel
aacacaaacacctgtaataagttggggtcagtgg

SEQ ID NO: 69766 - DNA, 32 bp, Artificial Sequence
  Indel
  Fig 1G sgPdia3 Indel
aacacaaacacctgtaataatggggtcagtgg

SEQ ID NO: 69767 - DNA, 33 bp, Artificial Sequence
  Indel
  Fig 1G sgPdia3 Indel
aacacaaacacctgtaatatatggggtcagtgg

SEQ ID NO: 69768 - DNA, 23 bp, Artificial Sequence
  Indel
  Fig 11C sgPDIA3
acgctaaaggttccaactactgg

SEQ ID NO: 69769 - DNA, 35 bp, Artificial Sequence
  Indel
  Fig 11C PDIA3  WT
aaagaacgctaaaggttccaactactggagaaaca

SEQ ID NO: 69770 - DNA, 34 bp, Artificial Sequence
  Indel
  Fig 11C PDIA3  Indel
aaagaacgctaaaggttccaacactggagaaaca

SEQ ID NO: 69771 - DNA, 34 bp, Artificial Sequence
  Indel
  Fig 11C PDIA3  Indel
aaagaacgctaaaggttccaatactggagaaaca

SEQ ID NO: 69772 - DNA, 33 bp, Artificial Sequence
  Indel
  Fig 11C PDIA3  Indel
aaagaacgctaaaggttccatactggagaaaca

SEQ ID NO: 69773 - DNA, 36 bp, Artificial Sequence
  Indel
  Fig 11C PDIA3  Indel
aaagaacgctaaaggttccaacttactggagaaaca

SEQ ID NO: 69774 - DNA, 34 bp, Artificial Sequence
  Indel
  Fig 11C PDIA3  Indel
aaagaacgctaaaggttccactactggagaaaca

SEQ ID NO: 69775 - DNA, 23 bp, Artificial Sequence
  Indel
  Fig 17A sgMII3
cctcatagctgttaggaattctc

SEQ ID NO: 69776 - DNA, 38 bp, Artificial Sequence
  Indel
  Fig 17A sgMII3 WT
ctaacctcatagctgttaggaattctcacgtgaagaag

SEQ ID NO: 69777 - DNA, 39 bp, Artificial Sequence
  Indel
  Fig 17A sgMII3 Indel
ctaacctcataagctgttaggaattctcacgtgaagaag

SEQ ID NO: 69778 - DNA, 31 bp, Artificial Sequence
  Indel
  Fig 17A sgMII3 Indel
ctaacctcataggaattctcacgtgaagaag

SEQ ID NO: 69779 - DNA, 37 bp, Artificial Sequence
  Indel
  Fig 17A sgMII3 Indel
ctaacctcatactgttaggaattctcacgtgaagaag

SEQ ID NO: 69780 - DNA, 36 bp, Artificial Sequence
  Indel
  Fig 17A sgMII3 Indel
ctaacctcatatgttaggaattctcacgtgaagaag

SEQ ID NO: 69781 - DNA, 36 bp, Artificial Sequence
  Indel
  Fig 17A sgMII3 Indel
ctaacctcagctgttaggaattctcacgtgaagaag

SEQ ID NO: 69782 - DNA, 37 bp, Artificial Sequence
  Indel
  Fig 17A sgMII3 Indel
ctaacctcatgctgttaggaattctcacgtgaagaag

SEQ ID NO: 69783 - DNA, 34 bp, Artificial Sequence
  Indel
  Fig 17A sgMII3 Indel
ctaacctcatattaggaattctcacgtgaagaag

SEQ ID NO: 69784 - DNA, 35 bp, Artificial Sequence
  Indel
  Fig 17A sgMII3 Indel
ctaacctcatagttaggaattctcacgtgaagaag

SEQ ID NO: 69785 - DNA, 37 bp, Artificial Sequence
  Indel
  Fig 17A sgMII3 Indel
ctaacctcaagctgttaggaattctcacgtgaagaag

SEQ ID NO: 69786 - DNA, 33 bp, Artificial Sequence
  Indel
  Fig 17A sgMII3 Indel
ctaacctcatataggaattctcacgtgaagaag

SEQ ID NO: 69787 - DNA, 23 bp, Artificial Sequence
  Indel
  Fig 17A sgB2m
ggtcgcttcagtcgtcagcatgg

SEQ ID NO: 69788 - DNA, 40 bp, Artificial Sequence
  Indel
  Fig 17A sgB2m WT
cagtcgcggtcgcttcagtcgtcagcatggctcgctcggt

SEQ ID NO: 69789 - DNA, 40 bp, Artificial Sequence
  Indel
  Fig 17A sgB2m Indel
cagtcgcggtcgcttcagtcatcagcatggctcgctcggt

SEQ ID NO: 69790 - DNA, 38 bp, Artificial Sequence
  Indel
  Fig 17A sgB2m Indel
cagtcgcggtcgcttcaggtcagcatggctcgctcggt

SEQ ID NO: 69791 - DNA, 33 bp, Artificial Sequence
  Indel
  Fig 17A sgB2m Indel
cagtcgcggtcgcttcagcatggctcgctcggt

SEQ ID NO: 69792 - DNA, 28 bp, Artificial Sequence
  Indel
  Fig 17A sgB2m Indel
cagtcgcggtcgcttcagttcgctcggt

SEQ ID NO: 69793 - DNA, 39 bp, Artificial Sequence
  Indel
  Fig 17A sgB2m Indel
cagtcgcggtcgcttcagtcgtagcatggctcgctcggt

SEQ ID NO: 69794 - DNA, 37 bp, Artificial Sequence
  Indel
  Fig 17A sgB2m Indel
cagtcgcggtcgcttcagtcagcatggctcgctcggt

SEQ ID NO: 69795 - DNA, 37 bp, Artificial Sequence
  Indel
  Fig 17A sgB2m Indel
cagtcgcggtcgcttcagtcgtcatggctcgctcggt

SEQ ID NO: 69796 - DNA, 36 bp, Artificial Sequence
  Indel
  Fig 17A sgB2m Indel
cagtcgcggtcgcttcagtcgcatggctcgctcggt

SEQ ID NO: 69797 - DNA, 30 bp, Artificial Sequence
  Indel
  Fig 17A sgB2m Indel
cagtcgcggtcgcttcatggctcgctcggt

SEQ ID NO: 69798 - DNA, 34 bp, Artificial Sequence
  Indel
  Fig 17A sgB2m Indel
cagtcgcggtcgcttcaagcatggctcgctcggt

SEQ ID NO: 69799 - DNA, 42 bp, Artificial Sequence
  Indel
  Fig 17D SB Integration
taaaaactatttttatcaaatacagttgaagtcggaagttta

SEQ ID NO: 69800 - DNA, 42 bp, Artificial Sequence
  Indel
  Fig 17D SB Integration
taaaactattatctgataactacagttgaagtcggaagttta

SEQ ID NO: 69801 - DNA, 41 bp, Artificial Sequence
  Indel
  Fig 17D SB Integration
gctttcaatacatcctgtttacagttgaagtcggaagttta

SEQ ID NO: 69802 - DNA, 42 bp, Artificial Sequence
  Indel
  Fig 17D SB Integration
ttcacggcgactactgcacttacagttgaagtcggaagttta

SEQ ID NO: 69803 - DNA, 42 bp, Artificial Sequence
  Indel
  Fig 17D SB Integration
ggatgggtacaagatgagtatacagttgaagtcggaagttta

SEQ ID NO: 69804 - DNA, 42 bp, Artificial Sequence
  Indel
  Fig 17D SB Integration
tcaccctctccaaccagccctacagttgaagtcggaagttta

SEQ ID NO: 69805 - protein, 13 aa, Artificial Sequence
  TCR
  Fig 20E TCR1A
CAASGVYAQGLTF

SEQ ID NO: 69806 - protein, 12 aa, Artificial Sequence
  TCR
  Fig 20E TCR1B1
CSADMGRTEVFF

SEQ ID NO: 69807 - protein, 13 aa, Artificial Sequence
  TCR
  Fig 20E TCR1B2
CASGGTGQNTLYF

SEQ ID NO: 69808 - protein, 14 aa, Artificial Sequence
  TCR
  Fig 20E TCR2A
CALSDLNAGAKLTF

SEQ ID NO: 69809 - protein, 16 aa, Artificial Sequence
  TCR
  Fig 20E TCR2B
CASDRWGAQGAETLYF

SEQ ID NO: 69810 - protein, 16 aa, Artificial Sequence
  TCR
  Fig 20E TCR3A
CAMREGSGGSNYKLTF

SEQ ID NO: 69811 - protein, 15 aa, Artificial Sequence
  TCR
  Fig 20E TCR3B
CASSRRGGNYAEQFF

SEQ ID NO: 69812 - protein, 14 aa, Artificial Sequence
  TCR
  Fig 20E TCR4B
CASSLGRGRAEQFF

SEQ ID NO: 69813 - protein, 14 aa, Artificial Sequence
  TCR
  Fig 20E TCR5A1
CATDASSGSWQLIF

SEQ ID NO: 69814 - protein, 13 aa, Artificial Sequence
  TCR
  Fig 20E TCR5A2
CALGANSNNRIFF

SEQ ID NO: 69815 - protein, 15 aa, Artificial Sequence
  TCR
  Fig 20E TCR5B
CASSSRDRSNERLFF

SEQ ID NO: 69816 - protein, 12 aa, Artificial Sequence
  TCR
  Fig 20E TCRA1
CATDNAGAKLTF

SEQ ID NO: 69817 - protein, 14 aa, Artificial Sequence
  TCR
  Fig 20E TCRB1
CASGDRGKNERLFF

SEQ ID NO: 69818 - protein, 16 aa, Artificial Sequence
  TCR
  Fig 20E TCRB2
CASSEGWGANYAEQFF

SEQ ID NO: 69819 - protein, 14 aa, Artificial Sequence
  TCR
  Fig 20E TCRA2
CAAPASSGSWQLIF

SEQ ID NO: 69820 - protein, 12 aa, Artificial Sequence
  TCR
  Fig 20E TCRA3
CAVRYNNNAPRF

SEQ ID NO: 69821 - DNA, 5745 bp, Artificial Sequence
  Vector
  pLY017SB_pAAV-U6sg (BbsI)-EFS-Thy1
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcacgcgttctagactatacagttgaagtcggaagtttacatacacttaagttggagtcattaaaactcgtttttcaactactccacaaatttcttgttaacaaacaatagttttggcaagtcagttaggacatctactttgtgcatgacacaagtcatttttccaacaattgtttacagacagattatttcacttataattcactgtatcacaattccagtgggtcagaagtttacatacactaagttgactgtgcctttaaacagcttggaaaattccagaaaatgatgtcatggctttagagaggatccgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgggtcttcgagaagacctgttttagagctagaaatagcaagttaaaataaggctagtccgttatcaacttgaaaaagtggcaccgagtcggtgcttttttggctagctggccgcgtttaaacgtcgactaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggctcgagatgaacccagccatcagcgtcgctctcctgctctcagtcttgcaggtgtcccgagggcagaaggtgaccagcctgacagcctgcctggtgaaccaaaaccttcgcctggactgccgccatgagaataacaccaaggataactccatccagcatgagttcagcctgacccgagagaagaggaagcacgtgctctcaggcacccttgggatacccgagcacacgtaccgctcccgcgtcaccctctccaaccagccctatatcaaggtccttaccctagccaacttcaccaccaaggatgagggcgactacttttgtgagcttcgcgtgtcgggcgcgaatcccatgagctccaataaaagtatcagtgtgtatagagacaagctggtcaagtgtggcggcataagcctgctggttcagaacacatcctggatgctgctgctgctgctttccctctccctcctccaagccctggacttcatttctctgggcagtggagagggcagaggaagtctgctaacatgcggtgacgtcgaggagaatcctggcccaatgggaaaatcaaaagaaatcagccaagacctcagaaaaagaattgtagacctccacaagtctggttcatccttgggagcaatttccaaacgcctggcggtaccacgttcatctgtacaaacaatagtacgcaagtataaacaccatgggaccacgcagccgtcataccgctcaggaaggagacgcgttctgtctcctagagatgaacgtactttggtgcgaaaagtgcaaatcaatcccagaacaacagcaaaggaccttgtgaagatgctggaggaaacaggtacaaaagtatctatatccacagtaaaacgagtcctatatcgacataacctgaaaggccactcagcaaggaagaagccactgctccaaaaccgacataagaaagccagactacggtttgcaactgcacatggggacaaagatcgtactttttggagaaatgtcctctggtctgatgaaacaaaaatagaactgtttggccataatgaccatcgttatgtttggaggaagaagggggaggcttgcaagccgaagaacaccatcccaaccgtgaagcacgggggtggcagcatcatgttgtgggggtgctttgctgcaggagggactggtgcacttcacaaaatagatggcatcatggacgcggtgcagtatgtggatatattgaagcaacatctcaagacatcagtcaggaagttaaagcttggtcgcaaatgggttttccaacacgacaatgaccccaagcatacttccaaagttgtggcaaaatggcttaaggacaacaaagtcaaggtattggagtggccatcacaaagccctgacctcaatcctatagaaaatttgtgggcagaactgaaaaagcgtgtgcgagcaaggaggcctacaaacctgactcagttacaccagctctgtcaggaggaatgggccaaaattcacccaaattattgtgggaagcttgtggaaggctacccgaaacgtttgacccaagttaaacaatttaaaggcaatgctaccaaatactaggggccctaaccgcgggaataaaagatctttattttcattagatctgtgtgttggttttttgtgtgaattcttgagtgtatgtaaacttctgacccactgggaatgtgatgaaagaaataaaagctgaaatgaatcattctctctactattattctgatatttcacattcttaaaataaagtggtgatcctaactgacctaagacagggaatttttactaggattaaatgtcaggaattgtgaaaaagtgagtttaaatgtatttggctaaggtgtatgtaaacttccgacttcaactgtataggcatgcggtaaccacgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 69822 - DNA, 20 bp, Artificial Sequence
  sgRNA
  Downstream Spacer
gttttagagctagaaatggc

SEQ ID NO: 69823 - DNA, 20 bp, Artificial Sequence
  sgRNA
  Upstream Spacer
gtggaaaggacgaaacaccg

SEQ ID NO: 69824 - DNA, 61 bp, Artificial Sequence
  Primer
  Splinkerette adaptor-F
cgaagagtaaccgttgctaggagagaccgtggctgaatgagactggtgtcgacactagtgg

SEQ ID NO: 69825 - DNA, 48 bp, Artificial Sequence
  Primer
  Splinkerette adaptor-R
gatcccactagtgtcgacaccagtctctaattttttttttcaaaaaaa

SEQ ID NO: 69826 - DNA, 28 bp, Artificial Sequence
  Primer
  Splink 1
cgaagagtaaccgttgctaggagagacc

SEQ ID NO: 69827 - DNA, 30 bp, Artificial Sequence
  Primer
  SB-Right1
actgacctaagacagggaatttttactagg

SEQ ID NO: 69828 - DNA, 25 bp, Artificial Sequence
  Primer
  Splink 2
gtggctgaatgagactggtgtcgac

SEQ ID NO: 69829 - DNA, 33 bp, Artificial Sequence
  Primer
  SB-Right 2
agtgagtttaaatgtatttggctaaggtgtatg

SEQ ID NO: 69830 - DNA, 27 bp, Artificial Sequence
  Primer
  TRAC-left-F
gaccactccagatttcaagatgtacag

SEQ ID NO: 69831 - DNA, 24 bp, Artificial Sequence
  Primer
  TRAC-left-R
ggtcagggttctggatatctgtgg

SEQ ID NO: 69832 - DNA, 27 bp, Artificial Sequence
  Primer
  TARC-right-F
gagagactctaaatccagtgacaagtc

SEQ ID NO: 69833 - DNA, 22 bp, Artificial Sequence
  Primer
  TARC-right-R
gtgggttaatgagtgactgcgt

SEQ ID NO: 69834 - DNA, 27 bp, Artificial Sequence
  Primer
  HDRwt-F2
gagagagcaatctcctggtaatgtgat

SEQ ID NO: 69835 - DNA, 22 bp, Artificial Sequence
  Primer
  HDRwt-R3
aggcagacagacttgtcactgg

SEQ ID NO: 69836 - DNA, 22 bp, Artificial Sequence
  Primer
  EGFRvIII-R1
tctggatgtcggggatcagcag

SEQ ID NO: 69837 - DNA, 252 bp, Artificial Sequence
  DNA
  L1L2 Constant
atccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaact

SEQ ID NO: 69838 - DNA, 7331 bp, Artificial Sequence
  Vector
  RH2.2 with A9
gaattcccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcacttcaccaacaaggaccatagattatgaaaaagaatatcgcatttcttcttgcatctatgttcgttttttctattgctacaaatgcctatgcatccatggcatccgatatccagatgacccagtccccgagctccctgtccgcctctgtgggcgatagggtcaccatcacctgccgtgccagtcagtccgtgtccagcgctgtagcctggtatcaacagaaaccaggaaaagctccgaagcttctgatttactcggcatccagcctctactctggagtcccttctcgcttctctggtagccgttccgggacggatttcactctgaccatcagcagtctgcagccggaagacttcgcaacttattactgtcagcaatggtaccattactcttacccgatcacgttcggacagggtaccaaggtggagatcaaacgaactgtggctgcaccatctgtcttcatcttcccgccatctgattcacagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgaaaaacataaagtctacgcctgcgaagtcacccatcagggcctgagctcgcccgtcacaaagagcttcaacaggggagagtgtggtggttctgattacaaagatgacgatgacaaataattaactcgaggctgagcaaagcagactactaataacataaagtctacgccggacgcatcgtggccctagtacgcaagttcacgtaaaaagggtaactagaggttgaggtgattttatgaaaaagaatatcgcatttcttcttgcatctatgttcgttttttctattgctacaaacgcgtacgctgagatctccgaggttcagctggtggagtctggcggtggcctggtgcagccagggggctcactccgtttgtcctgtgcagcttctggcttcaacttttcttcttcttctatacactgggtgcgtcaggccccgggtaagggcctggaatgggttgcatctatttcttcttattatagctctacttattatgccgatagcgtcaagggccgtttcactataagcgcagacacatccaaaaacacagcctacctacaaatgaacagcttaagagctgaggacactgccgtctattattgtgctcgcactgttcgtggatccaaaaaaccgtacttctctggttgggctatggactactggggtcaaggaaccctggtcaccgtctcctcggcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactcgctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatctagacaccaccaccaccaccactaaagtggttccggtgattttgattatgaaaagatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttccctccctcaatcggttgaatgtcgcccttttgtctttagcgctggtaaaccatatgaattttctattgattgtgacaaaataaacttattccgtggtgtctttgcgtttcttttatatgttgccacctttatgtatgtattttctacgtttgctaacatactgcgtaataaggagtcttaatcatgccagttcttttggctagcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggatccggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggctatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccggatcctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaa

SEQ ID NO: 69839 - DNA, 20 bp, Artificial Sequence
  Primer
  Cutadapt 1
cgcacgcgttctagactata

SEQ ID NO: 69840 - DNA, 20 bp, Artificial Sequence
  Primer
  Cutadapt 2
tataggcatgcggtaaccac

SEQ ID NO: 69841 - DNA, 20 bp, Artificial Sequence
  Primer
  Cutadapt 3
cagttgaagtcggaagttta
